US008697948B2

(12) United States Patent
Sanz Molinero et al.

(10) Patent No.: US 8,697,948 B2
(45) Date of Patent: Apr. 15, 2014

(54) PLANTS HAVING ENHANCED YIELD-RELATED TRAITS AND A METHOD FOR MAKING THE SAME

(75) Inventors: Ana Isabel Sanz Molinero, Gentbrugge (BE); Ramon Serrano Salom, Valencia (ES); José Miguel Mulet Salort, Valencia (ES)

(73) Assignee: BASF Plant Science GmbH, Ludwigshafen (DE)

( * ) Notice: Subject to any disclaimer, the term of this patent is extended or adjusted under 35 U.S.C. 154(b) by 476 days.

(21) Appl. No.: 12/744,503

(22) PCT Filed: Nov. 26, 2008

(86) PCT No.: PCT/EP2008/066237
§ 371 (c)(1),
(2), (4) Date: May 25, 2010

(87) PCT Pub. No.: WO2009/068564
PCT Pub. Date: Jun. 4, 2009

(65) Prior Publication Data
US 2010/0313299 A1 Dec. 9, 2010

Related U.S. Application Data

(60) Provisional application No. 61/014,757, filed on Dec. 19, 2007, provisional application No. 61/014,619, filed on Dec. 18, 2007, provisional application No. 61/013,649, filed on Dec. 14, 2007, provisional application No. 61/013,648, filed on Dec. 14, 2007, provisional application No. 61/027,053, filed on Feb. 8, 2008, provisional application No. 61/106,989, filed on Oct. 21, 2008.

(30) Foreign Application Priority Data

| Nov. 26, 2007 | (EP) | 07121546 |
| Nov. 26, 2007 | (EP) | 07121565 |
| Dec. 6, 2007 | (EP) | 07122488 |
| Dec. 11, 2007 | (EP) | 07122911 |
| Dec. 12, 2007 | (EP) | 07122998 |
| Oct. 15, 2008 | (EP) | 08166636 |

(51) Int. Cl.
*C12N 15/82* (2006.01)
*C12N 15/63* (2006.01)

(52) U.S. Cl.
USPC .......................... 800/278; 435/468

(58) Field of Classification Search
None
See application file for complete search history.

(56) References Cited

U.S. PATENT DOCUMENTS

| 2004/0034888 A1 | 2/2004 | Liu et al. | |
| 2004/0123343 A1* | 6/2004 | La Rosa et al. | 800/278 |
| 2005/0108791 A1* | 5/2005 | Edgerton | 800/284 |
| 2006/0123505 A1* | 6/2006 | Kikuchi et al. | 800/278 |
| 2007/0250956 A1 | 10/2007 | Rothstein et al. | |
| 2009/0100536 A1* | 4/2009 | Adams et al. | 800/260 |

FOREIGN PATENT DOCUMENTS

| WO | WO-00/03026 A2 | 1/2000 |
| WO | WO-01/81599 A2 | 11/2001 |
| WO | WO-02/16655 A2 | 2/2002 |
| WO | WO-2004/031349 A2 | 4/2004 |
| WO | WO-2004/090141 A2 | 10/2004 |
| WO | WO-2005/094562 A1 | 10/2005 |
| WO | WO-2006/074547 A1 | 7/2006 |
| WO | WO-2006/130156 A2 | 12/2006 |
| WO | WO-2009/000789 A1 | 12/2008 |

OTHER PUBLICATIONS

Mayer et al. (NCBI, GenBank Sequence Accession No. Q9M0R2; Published Feb. 7, 2006).*
Doerks et al., (TIG, 14:248-250, 1998).*
Smith et al. (Nature Biotechnology, 15:1222-1223, 1997).*
Bork et al. (TIG, 12:425-427, 1996).*
Wells, Biochemistry 29:8509-8517, 1990.*
Ngo et al., The Protein Folding Problem and Tertiary Structure Prediction, K. Merz., and S. Le Grand (eds.) pp. 492-495,1994.*
Keskin et al. (Protein Science, 13:1043-1055, 2004).*
Thornton et al. (Nature structural Biology, structural genomics supplement, Nov. 2000).*
Monks et al., Plant Cell, 13:1205-1219; 2001.*
Kapranov et al., Plant Cell., 13:1369-1382, 2001.*
Maniatis et al. (Molecular Cloning: A Laboratory Manual, Cold Spring Harbor Laboratory, 1982; pp. 387-389).*
Sasaki et al. (NCBI, Gen Bank Sequence Accession No. Q8RYZ1; Published Feb. 1, 2005.*
de Pater et al. (Plant Journal, 2:837-844, 1992).*
Aasland, et al., "The SANT domain: a putative DNA-binding domain in the SWI-SNF and ADA complexes, the transcriptional corepressor N-CoR and TFIIIB," *Trends Biochem. Sci.* (1996), vol. 21, pp. 87-88.

(Continued)

*Primary Examiner* — Vinod Kumar
(74) *Attorney, Agent, or Firm* — Novak Druce Connolly Bove + Hutz LLP

(57) ABSTRACT

The present invention concerns a method for enhancing yield-related traits in plants by modulating expression in a plant of a nucleic acid encoding a PATL (PATELLIN) polypeptide, or a PRP38 (Precursor RNA Processing factor 38) polypeptide, or an ADA2 (Adaptor 2) polypeptide. The present invention also concerns a method for increasing Thousand Kernel Weight, total weight of seeds and/or number of filled seeds, by modulating expression in a plant of a nucleic acid sequence encoding a GATA-like polypeptide. The invention also concerns a method for increasing various plant yield-related traits by, increasing expression in a plant of a nucleic acid sequence encoding a WD40 repeat (WDR) 23-like polypeptide. The invention also provides hitherto unknown PATL nucleic acids and constructs useful in the methods of the invention.

6 Claims, 141 Drawing Sheets

(56) References Cited

OTHER PUBLICATIONS

Allen-Baume, et al., "Current thoughts on the phosphatidylinositol transfer protein family," *FEBS Letters* (2002), vol. 531, pp. 74-80.
Anantharaman, et al., "The GOLD domain, a novel protein module involved in Golgi function and secretion," *Genome Biology* (2002), vol. 3, No. 5, research0023.1-0023.7.
Angers et al., "Molecular architecture and assembly of the DDB1-CUL4A ubiquitin ligase machinery," *Nature* (2006), vol. 443, pp. 590-593.
Bankaitis, et al., "An essential role for a phospholipid transfer protein in yeast Golgi function," Nature (1990), vol. 347, pp. 561-562.
Bankaitis, et al., "The *Saccharomyces cerevisiae* SEC14 Gene Encodes a Cytosolic Factor That Is Required for Transport of Secretory Proteins from the Yeast Golgi Complex," *The Journal of Cell Biology* (1989), vol. 108, pp. 1271-1281.
Blanton, et al., "*PRP38* Encodes a Yeast Protein Required for Pre-mRNA Splicing and Maintenance of Stable U6 Small Nuclear RNA Levels," *Molecular and Cellular Biology* (1992), vol. 12, No. 9, pp. 3939-3947.
Daniel-Vedele, et al., "A tobacco cDNA clone encoding a GATA-1 zinc finger protein homologous to regulators of nitrogen metabolism in fungi," *Mol. Gen. Genet* (1993), vol. 240, pp. 365-373.
De Levie, "The Henderson-Hasselbalch Equation: Its History and Limitations," *Journal of Chemical Education* (2003), vol. 80, No. 2, p. 146.
Finn, et al., The evolving model of calmodulin structure, function and activation, *Structure* (1995), vol. 3, pp. 7-11.
Forment, et al., "Expression of *Arabidopsis* SR-like splicing proteins confers salt tolerance to yeast and transgenic plants," *The Plant Journal* (2002), vol. 30, No. 5, pp. 511-519.
Gao, et al., "DRTF: a database of rice transcription factors," *Bioinformatics* (2006), vol. 22, No. 10, pp. 1286-1287.
Ghirlando, et al., "Determinants of GATA-1 Binding to DNA," *The Journal of Biological Chemistry* (2003), vol. 278, No. 46, pp. 45620-45628.
Gottschalk, et al., "Identification by mass spectrometry and functional analysis of novel proteins of the years [U4/U6.U5] tri-snRNP," *The EMBO Journal* (1999), vol. 18, No. 16, pp. 4535-4548.
Gutterson, et al., "Regulation of disease resistance pathways by AP2/ERF transcription factors," *Current Opinion in Plant Biology* (2004), vol. 7, pp. 465-471.
Haselbach, *Biochemische Zeitschrift* (1917), vol. 78, pp. 112-144.
He, et al., "DDB1 functions as a linker to recruit receptor WD40 proteins to CUL4-ROC1 ubiquitin ligases," *Genes & Development* (2006), vol. 20, pp. 2949-2954.
Henderson, "Concerning the Relationship Between the Strength of Acids and Their Capacity to Preserve Neutrality," *Am. J. Physiol.* (1908), vol. 21, pp. 173-179.
Higa, et al., "CUL4-DDB1 ubiquitin ligase interacts with multiple WD40-repeat proteins and regulates histone methylation," *Nature Cell Biology* (2006), vol. 8, No. 11, pp. 1277-1283.
Higa, et al., "Stealing the spotlight: CUL4-DDB1 ubiquitin ligase docks WD40-repeat proteins to destroy," *Cell Division* (2007), 2:5, pp. 1-9.
Jouannic, et al., "Isolation of a cDNA from *Arabidopsis thaliana* that complements the *sec14* mutant of yeast," *Eur. J. Biochem.* (1998), vol. 258, pp. 402-410.
Kalyna, et al., "A plethora of plant serine/arginine-rich proteins: redundancy or evolution of novel gene functions?," *Biochem. Soc. Trans.* (2004), vol. 32, pp. 561-564.
Kapranov, et al., "Nodule-Specific Regulation of Phosphatidylinositol Transfer Protein Expression in *Lotus japonicus*," *The Plant Cell* (2001), vol. 13, pp. 1369-1382.
Kearns, et al., "Novel developmentally regulated phosphoinositide binding proteins from soybean whose expression bypasses the requirement for an essential phosphatidylinositol transfer protein in yeast," *The EMBO Journal* (1998), vol. 17, No. 14, pp. 4004-4017.
Li, et al., "Phosphatidylinositol/phosphatidylcholine transfer proteins in yeast," *Biochimica at Biophysica Acta* (2000), vol. 1486, pp. 55-71.
Lee, et al., "Stabilized1, a Stress-Upregulated Nuclear Protein, Is Required for Pre-mRNA Splicing, mRNA Turnover, and Stress Tolerance in *Arabidopsis*," *The Plant Cell* (2006), vol. 18, pp. 1736-1749.
Da, et al., "Structure and function of the SWIRM domain, a conserved protein module found in chromatin regulatory complexes," *PNAS* (2006), vol. 103, No. 7, pp. 2057-2062.
Lupas, et al., "Predicting Coiled Coils from Protein Sequences," *Science*, vol. 252, pp. 1162-1164.
McDonnell, et al., "Paircoil2: improved prediction of coiled coils from sequence," *Bioinformatics* (2006), vol. 22, No. 3, pp. 356-358.
Mao, et al., "Physical and functional interactions of *Arabidopsis* ADA2 transcriptional coactivator proteins with the acetyltransferase GCN5 and with the cold-induced transcription factor CBF1," *Biochimica et Biophysica Acta* (2006), vol. 1759, pp. 69-79.
Martin, et al., "Transcriptional activation and DNA binding by the erythroid factor GF-1/NF-E1/Eryf 1," *Genes & Development* (1990), vol. 4, No. 11, pp. 1886-1898.
Monks, et al., "Hyperosmotic Stress Induces the Rapid Phosphorylation of a Soybean Phosphatidylinositol Transfer Protein Homolog through Activation of the Protein Kinases SPK1 and SPK2," *The Plant Cell* (2001), vol. 13, pp. 1205-1219.
Narlikar, et al., "Cooperation between Complexes that Regulate Chromatin Structure and Transcription," *Cell* (2002), vol. 108, pp. 475-487.
Omichinski, et al., "NMR Structure of a Specific DNA Complex of Zn-Containing DNA Binding Domain of GATA-1," *Science* (Jul. 23, 1993), vol. 261, pp. 438-446.
Pandit, et al., "Inhibition of a spliceosome turnover pathway suppresses splicing defects," *PNAS* (2006), vol. 103, No. 37, pp. 13700-13705.
Pevny, et al., "Erythroid differentiation in chimaeric mice blocked by a targeted mutation in the gene for transcription factor GATA-1," *Nature* (1991), vol. 349, pp. 257-260.
Ponting, et al., "ZZ and TAZ: new putative zinc fingers in dystrophin and other proteins," *Trends Biochem. Sci.* (1996), vol. 21, pp. 11-13.
Reyes, et al., "The GATA Family of Transcription Factors in *Arabidopsis* and Rice," *Plant Physiology* (2004), vol. 134, pp. 1718-1732.
Sha, et al., "PI transfer protein: the specific recognition of phospholipids and its functions," *Biochimica et Biophysica Acta* (1999), vol. 1441, pp. 268-277.
Smith, et al., "The WD repeat: a common architecture for diverse functions," *TIBS* (1999) vol. 24, pp. 181-185.
Stevens, et al., "Purification of the yeast U4/U6.U5 small nuclear ribonucleoprotein particle and identification of its proteins," *Proc. Natl. Acad. Sci. USA* (1999), vol. 96, pp. 7226-7231.
Stockinger, et al., "Transcriptional adaptor and histone acetyltransferase proteins in *Arabidopsis* and their interactions with CBF1, a transcriptional activator involved in cold-regulated gene expression," *Nucleic Acids Research* (2001), vol. 29, No. 7, pp. 1524-1533.
Stryer, "Membrane Structure and Function" (Chapter 11) in Biochemistry, 4$^{th}$ edition, Stryer (ed.), (1995), pp. 263-267.
Teakle, et al., "*Arabidopsis thaliana* GATA factors: organisation, expression and DNA-binding binding characteristics," *Plant Molecular Biology* (2002), vol. 50, pp. 43-57.
Vinocur, et al., "Recent advances in engineering plant tolerance to abiotic stress: achievements and limitations," *Current Opinion in Biotechnology* (2005), vol. 16, pp. 123-132.
Vlachonasios, et al., "Disruption Mutations of *ADA2b* and *GCN5* Transcriptional Adaptor Genes Dramatically Affect *Arabidopsis* Growth, Development, and Gene Expression," *The Plant Cell* (2003), vol. 15, pp. 626-638.
Xie, et al., "Progression through the spliceosome cycle requires Prp38p function for U4/U6 snRNA dissociation," *The EMBO Journal* (1998), vol. 17, No. 10, pp. 2938-2946.
Zhao, et al., "Hanaba Taranu Is a GATA Transcription Factor That Regulates Shoot Apical Meristem and Flower Development in *Arabidopsis*," *The Plant Cell* (2004), vol. 16, pp. 2586-2600.

(56) References Cited

OTHER PUBLICATIONS

Peterman, T.K., et al., "Molecular cloning and characterization of patellin1, a novel sec14-related protein, from zucchini (*Cucurbita pepo*)," Journal of Plant Physiology, 2006, vol. 163, pp. 1150-1150.

Peterman, T.K., et al., "Patellin1, a novel sec14-like protein, localizes to the cell plate and binds phosphoinositides," Plant Physiology, 2004, vol. 136, pp. 3080-3094.

Peterman, K., et al., "Functional analysis of patellin1, a cell-plate localized, phosphoinositide-binding protein," Abstract from Annual Meeting of the American Society of Plant Biologists, Plant Biology, 2004.

Peterman, T.K., et al., "Molecular cloning and characterization of patellin1, a novel sec14-related protein, from zucchini (*Cucurbita pepo*)," Journal of Plant Physiology, 2006, vol. 163, pp. 1150-1158.

European Search Report for EP 12 19 5088, dated Mar. 1, 2013.

Bi et al., "Genetic Analysis of *Arabidopsis* GATA Transcription Factor Gene Family Reveals a Nitrate-Inducible Member Important for Chlorophyll Synthesis and Glucose Sensitivity", The Plant Journal, 2005, vol. 44, pp. 680-692.

Shikata et al., "Characterization of *Arabidopsis ZIM*, a Member of a Novel Plant-Specific GATA Factor Gene Family", 2004, Journal of Experimental Botany, vol. 55, No. 397, pp. 631-639.

European Search Report for EP 12 19 5092, dated Mar. 6, 2013.

\* cited by examiner

MAEEPQPEAAPAAVAATTEVAVAEKAPVEAEKEKKVEEETPAVEAEAK*EEK*KDEAA

AAAAAGGDEAGAIEGTGSFKEESNLVADLPDPEKKALDEFKQLIAAALAACEFNLP

PPPPPP<u>KAKVEAAVEETKAEETKAEEE</u>PKAEEPAKEEEPKAEVVAAAAAPPEAGTE
        coiled coil

EPKAEASSEEAKTEEPKAEAAADEPAKEESKAEAAPAEEAKPAEPEP*EEK*TVVVTE

EEAATKTVEaieetvvpaaaapaaaateeaaapepevQAAAAPEPVLIWGVPLVGD
        salt bridge

DERTDTVLLKFLRAREFKVKEAMAMLRSAVLWRKRFGIESLLDADLALPELDSVVF
        SEC14 domain

YRGADREGHPVCYNVYGEFQDKDLYEKAFGD*EEK*RERFLKWRIQLLERGILSQLDF
        SEC14 domain

SPSGICSMVQVTDLKNSPPMLGKHRAVTRQAVALLQDNYPEFIAKKVFINVPWWYL
        SEC14 domain

AANKMMSPFLTQRTKSKFIFASPAKSAETLFRYIAPEQVPVQFGGLFKEDDPEFTT
        SEC14 domain

<u>SDAVTELTIKPSSKETVEIPVTENSTIGWELRVLGWEVSYGAEFTPDAEGGYTVIV</u>
        <u>GOLD domain</u>

<u>QKTRKVPANEEPIMKGSFKVGEPGKIVLTINNPASKKKKLLYRSKV</u>KSTSESV
        <u>GOLD domain</u>

FIGURE 1

```
                      1                                                50
Arath_PATL1_1    (1)  ---------------------MAQEEVQKSADVAAAPVVKEK-------
Arath_PATL1_3    (1)  ---------------------MAQEEIQK--PTASVPVVKEET------
Arath_PATL1_2    (1)  --------------------------------------------------
 Brana_PATL_1    (1)  --------------------------------------------------
Arath_PATL1_6    (1)  MSQDSATTTPPPPLTSDVSMPSGEEDEPKHVTSEEEAPVTSETNLKLPLM
  Helan_PATL_1   (1)  --------------------------------------------------
  Glyma_PATL_3   (1)  --------------------------------------------------
Arath_PATL1_4    (1)  --------------------------------------------------
 Orysa_PATL1_2   (1)  --------------------------------------------------
  Zeama_PATL_1   (1)  --------------------------------------------------
Arath_PATL1_5    (1)  --------------------------------------------------
 Orysa_PATL1_4   (1)  --------------------------------------------------
 Orysa_PATL1_1   (1)  --------------------MAEEPQPEAAPAAVAATTEV---------
  Zeama_PATL_3   (1)  --------------------------------------------------
  Triae_PATL_2   (1)  --------------------MAEEPQPQAAAAPAAAATEV---------
 Orysa_PATL1_3   (1)  --------------------MAEEAKQETPAAAEVVVVEK---------
  Triae_PATL_3   (1)  --------------------------------------------------
  Zeama_PATL_2   (1)  --------------------MADETKQEAAAPAAEVVVTEEEKK----
  Glyma_PATL_1   (1)  --------------------------------------------------
  Glyma_PATL_2   (1)  --------------------------------------------------
     Consensus   (1)

51                                               100
Arath_PATL1_1   (22)  ------------PITDKEVTIPTPVAEKEEVAAPVSDEKAVPEKEVTPE
Arath_PATL1_3   (21)  ------------PAPVKEVEVPVTTEKAVAAPAPEATEEKVVSEVAVPE
Arath_PATL1_2    (1)  --------------------------------------------------
 Brana_PATL_1    (1)  --------------------------------------------------
Arath_PATL1_6   (51)  PELEESNHTAEVVSEKVTPETMTLESEGLNHAAEDSEQTHEVTPETETAK
  Helan_PATL_1   (1)  --------------------------------------------------
  Glyma_PATL_3   (1)  --------------------------------------------------
Arath_PATL1_4    (1)  --------------------------------------------------
 Orysa_PATL1_2   (1)  --------------------------------------------------
  Zeama_PATL_1   (1)  --------------------------------------------------
Arath_PATL1_5    (1)  -------------------MTAEVKVEEKQVESEVVIAPAVVPEETTV
 Orysa_PATL1_4   (1)  ------------------------MAVEVVSEGAAAAAAEVAAPET
 Orysa_PATL1_1  (21)  -------------------AVAEKAPVEAEKEKKVEEETPAVEAEAKEE
  Zeama_PATL_3   (1)  --------------------------------------------------
  Triae_PATL_2  (21)  -------------------VVAEKAPAEVEKK----AEEPAAEAEAEET
 Orysa_PATL1_3  (21)  -----------AD-----EVVAVEKAVEVEAE-----EKKLAEQEEEEE
  Triae_PATL_3   (1)  --------------------------------------------------
  Zeama_PATL_2  (25)  --------A---EETAPVAEEKAVEAAVEKAAEAEAGAEEKAAEADSEEE
  Glyma_PATL_1   (1)  --------------------------------------------------
  Glyma_PATL_2   (1)  -----------------------MAEEPQKPASAEEVVAVPAENPPSE
     Consensus  (51)
```

FIGURE 2

```
                    101                                              150
Arath_PATL1_1  (59) KEAPAAEAEKSVSVKEEE----TVVVAEKVVVLTAEEVQKKALEEFKELV
Arath_PATL1_3  (58) TEVTAVKEEEVATGKEILQS--ESFKEEGYLASELQEAEKNALAELKELV
Arath_PATL1_2   (1) --------------------------------------------------
 Brana_PATL_1   (1) --------------------------------------------------
Arath_PATL1_6 (101) LEVLNHTAEDSEQTHEVTPEKETVKSEFLNHVAEDSEQTHEVTPETETVK
 Helan_PATL_1   (1) --------------------------------------------------
 Glyma_PATL_3   (1) --------------------------------------------------
Arath_PATL1_4   (1) --------------------------------------------------
Orysa_PATL1_2   (1) --------------------------------------------------
Zeama_PATL_1    (1) --------------------------------------------------
Arath_PATL1_5  (30) KAVVEETKVEEDESKPEGVEKSASFKEESDFFADLKESEKKALSDLKSKL
Orysa_PATL1_4  (23) KEVTAKAAADEAVTLAAVVSKNASFREESNFLDDLKDGERKALAELRAKV
Orysa_PATL1_1  (51) KKDEAAAAAAGGDEAGAIEGTGSFKEESNLVADLPDPEKKALDEFKQLI
 Zeama_PATL_3   (1) --------------------------------------------------
 Triae_PATL_2  (47) --------AAVA-DDGGAVEATGSFKEESNLVADLPDPEKKALDEFKELI
Orysa_PATL1_3  (49) KKAEEAEEAAGG-DEAAVIEGTGSFKEESNLVSELPDPERTALAQLKELV
 Triae_PATL_3   (1) --------------------------------------------------
 Zeama_PATL_2  (64) KKAEEAEEAAAG-DEAAVIDGTGSFKEESNLVSELPDPERTALAQLKELV
 Glyma_PATL_1   (1) --------------------------------------------------
 Glyma_PATL_2  (26) AEAENIEAEKAQSGVEDKISQSVSFKEETNVVGDLPEAQKKALDELKKLV
    Consensus (101)                                  D 151                                              200
Arath_PATL1_1 (105) REALNKREFTAP------VTPVKEEKTEEKKTEEETK--EEEKTEEK---
Arath_PATL1_3 (106) REALNKREFTAPPP---PPAPVKEEKVEEKKTEETEEKKEEVKTEEKSLE
Arath_PATL1_2   (1) ------------------------------MAEEPTTTTLVTPEKLPS
 Brana_PATL_1   (1) --------------------------------------------------
Arath_PATL1_6 (151) SEVLNHAAEDSEQPRGVTPTPETETSEADTSLLVTSETEEPNHAAEDYSE
 Helan_PATL_1   (1) --------------------------------------------------
 Glyma_PATL_3   (1) --------------------------------------------------
Arath_PATL1_4   (1) --------------------------------------------------
Orysa_PATL1_2   (1) --------------------------------------------------
Zeama_PATL_1    (1) --------------------------------------------------
Arath_PATL1_5  (80) EEAIVDNTLLKTKK--KESSPMKEKKEEVVKPEAEVEKKKEEAAEEK---
Orysa_PATL1_4  (73) EEAIVDGKLFDDGK--VEAKKKAAAAE-----E---EKAVEEAAGEK---
Orysa_PATL1_1 (101) AAALAACEFNLPPP---PPPPKAKVEAAVEETKAEETKAEEEPKAEEPAK
 Zeama_PATL_3   (1) --------------------------------------------------
 Triae_PATL_2  (88) VAALAAGEFNLPPP---PPPPKAKTEAAAEETKTEAP-AKEEAKTEEPAK
Orysa_PATL1_3  (98) AAALAAGEFDLPPP---PPPPPAKAEEPAKEE-------E--PKAAEAPA
 Triae_PATL_3   (1) --------------------------------------------------
 Zeama_PATL_2 (113) ATALANGEFNLPPP---PAKEEAKKEEPAKEEAPADK--EDEPKAEEAAA
 Glyma_PATL_1   (1) --------------------------------------------------
 Glyma_PATL_2  (76) QEALNNHELTAPKPEPEKKKPAAEKKEEVEVTEGKKEAEVIEEKKEVEVT
    Consensus (151)   L                                              E
```

FIGURE 2 (continued)

```
                         201                                              250
Arath_PATL1_1     (144)  ---KEE------TTTEVKVE---------------------EEKPA
Arath_PATL1_3     (153)  AETKEEEKSAAPATVETKKEEILAAPAPIVAETKKEETPVAPAPVETKPA
Arath_PATL1_2      (19)  PSLTPS------EVSESTQD---------------------ALPTETETL
Brana_PATL_1       (1)   -------------------------------------------------
Arath_PATL1_6     (201)  TEPSQK------LMLEQRRK---------------------YMEVEDWTE
Helan_PATL_1       (1)   -------------------------------------------------
Glyma_PATL_3       (1)   -------------------------------------------------
Arath_PATL1_4      (1)   -------------------------------------------------
Orysa_PATL1_2      (1)   -------------------------------------------------
Zeama_PATL_1       (1)   -------------------------------------------------
Arath_PATL1_5    (125)   -------------------------------------------------
Orysa_PATL1_4    (110)   -------------------------------------------------
Orysa_PATL1_1    (148)   EE---------EPKAEVAAA---------------------AAAPPEAGT
Zeama_PATL_3       (1)   -------------------------------------------------
Triae_PATL_2     (134)   AE---------EPAKEEPK-----------------------------AE
Orysa_PATL1_3    (136)   AE---------EPK--AEAE---------------------AEAEAAATE
Triae_PATL_3       (1)   -------------------------------------------------
Zeama_PATL_2     (158)   QEPVKEEAKPEEPKTEAPAE---------------------AAPEEVKDE
Glyma_PATL_1       (1)   -------------------------------------------------
Glyma_PATL_2     (126)   EEKKEI------EVTEEKKE---------------------AEVIEEKKE
Consensus        (201)

251                                              300
Arath_PATL1_1    (160)   VPAAEEEK-----------------------SSEAAPVETKSEE-----
Arath_PATL1_3    (203)   APVVAETKKEEILPAAPVTTETKVEEKVVPVETTPAAPVTTETKEEEKAA
Arath_PATL1_2     (42)   EKVTETN----------------------PPETADTTTKPEEETAAEHHP
Brana_PATL_1       (1)   -------------------------------------------------
Arath_PATL1_6    (224)   PELPDEA----------------------VLEAAASVPEPKQPEPQTPPP
Helan_PATL_1       (1)   -------------------------------------------------
Glyma_PATL_3       (1)   -----------------------------------MAQNDSNPTPPP
Arath_PATL1_4      (1)   -------------------------------------------------
Orysa_PATL1_2      (1)   ------------------------------------------MSPTATP
Zeama_PATL_1       (1)   -------------------------------------------------
Arath_PATL1_5    (125)   VEEEKKSE-------------------------AV---VTEEAPKAETVE
Orysa_PATL1_4    (110)   KDGEEKK---------------------------------EE--------
Orysa_PATL1_1    (168)   EEPKAEA------------------------SSEEAKTEE-PKAEAAA
Zeama_PATL_3       (1)   -------------------------------------------------
Triae_PATL_2     (146)   EPAKAEA------------------------AAAEPAAEE-PKAVVAA
Orysa_PATL1_3    (154)   EPKTEEP------------------------KTEEPAKEEEPKAAAAA
Triae_PATL_3       (1)   -------------------------------------------------
Zeama_PATL_2     (187)   TPVPEET------------------------KTEAPAPEE-PKAEEPA
Glyma_PATL_1       (1)   -------------------------------------------------
Glyma_PATL_2     (149)   VEVTEEKKEIE-----------------VTEEKKEAEVKEEKKEGEVTE
Consensus        (251)
```

FIGURE 2 (continued)

```
                       301                                            350
Arath_PATL1_1    (181) ------KPEE---KAEVTTEKASSAEEDGTKTVEAIEESIVSVSPPES--
Arath_PATL1_3    (253) PVTTETKEEEKAAPGETKKEEKATASTQVKRASKFIKDIFVSVTTSEKKK
Arath_PATL1_2     (70) PTVTETETASTEKQEVKDEASQKEVAEEKKSMIPQNLG---SFKEESSKL
Brana_PATL_1       (1) --------------------------------------------------
Arath_PATL1_6    (252) PPSTTTSTVASRSLAEMMNREEAEVEEKQKIQIPRSLG---SFKEETNKI
Helan_PATL_1       (1) --------------------------------------------------
Glyma_PATL_3      (13) EP-----HVAAEPITEDLVQDKEEEDDSSKIVIPVPESESLSLKEDSNRV
Arath_PATL1_4      (1) ------MDASLSPFDHQKTQNTEPKKSFITSLITLRSNNIKEDTYFVS--
Orysa_PATL1_2      (8) SPAPAAVAAAPKPPPSGTGAKRSLMSSLMEATALLRSSSFKEDSYVAS--
Zeama_PATL_1       (1) --------------------------------------------------
Arath_PATL1_5    (147) AVVTEEIIPKEEVTTVVEKVEEETKEEEKKTEDVVTEE------------
Orysa_PATL1_4    (119) -------E---EPVTEEKKEEEQGEEEEEPKKEEADEG------------
Orysa_PATL1_1    (191) DEPAKEESKAEAAPAEEAKPAEP--EPEEKTVVVTEEEAATKTVEAIEET
Zeama_PATL_3       (1) --------------------------------------------------
Triae_PATL_2     (169) EAAAEEPAKEEPK-AEEAKPAEP--KKEEEAVVVAEEG--TKTAEPVEE-
Orysa_PATL1_3    (178) AAE----EPKAEAAAEEAKPAEP--ETEEKTVVVTEDEGTSKTVEAIEET
Triae_PATL_3       (1) --------------------------------------------------
Zeama_PATL_2     (210) KEELK-AEAATEAVAEETKPAEPVPEEEEKTVVVAEEEAT-KTVEAIEET
Glyma_PATL_1       (1) --------------------------------------------------
Glyma_PATL_2     (181) EKKEVEVTEEKKEAEVIVEEKKEVEVTEEKKEVEVTEGKKEVEVIEEKKE
    Consensus    (301)                                                  V 351                                            400
Arath_PATL1_1    (220) ------------------------AVAPVVVETVAVAEAEPVE--PEE
Arath_PATL1_3    (303) EEEKPAVVTIEKAFAADQEEETKTVEAVEESIVSITLPETAAYVE--PEE
Arath_PATL1_2    (117) SDLS-------------NSEKKSLDELKHLVREALDNHQFTN---TPEE
Brana_PATL_1       (1) --------------------------------------------------
Arath_PATL1_6    (299) SDLS-------------ETELNALQELRHLLQVSQDSSKTS--------
Helan_PATL_1       (1) --------------------------------------------------
Glyma_PATL_3      (58) SDS----------------EKNAIDELKKLLKEELEDEEVS--------
Arath_PATL1_4     (43) --------------------------ELKPTEQKSLQELKEKLSASSSKA
Orysa_PATL1_2     (56) --------------------------ALPASDLRALADLRALLSTHP-DP
Zeama_PATL_1       (1) --------------------------------------------------
Arath_PATL1_5    (185) ---------------------------VKAETIEVEDEDESVD---KD
Orysa_PATL1_4    (147) ---------------------------EKEEKPAEEEAAAVVD---KD
Orysa_PATL1_1    (239) VVPA-------------------AAAPAAAATEEAAAPEPEVQAAAAPEP
Zeama_PATL_3       (1) --------------------------------------------------
Triae_PATL_2     (213) -----------------------AAAAATTTEQAAAPEPE-AEAAAPEP
Orysa_PATL1_3    (222) -----------------------VVVAAPAAAAEA---EAAAPKE
Triae_PATL_3       (1) --------------------------------------------------
Zeama_PATL_2     (258) -----------------------VAVAVAAAASEEP--EAGEPKE
Glyma_PATL_1       (1) --------------------------------------------------
Glyma_PATL_2     (231) TEVT-------------EEKKEVEVEVREEKKESEVKEEEKGREVVPEE
    Consensus    (351)
```

FIGURE 2 (continued)

```
                     401                                              450
Arath_PATL1_1  (242) VSIWGVPLLQDER----------------SDVILTKFLRARDFKVKEALT
Arath_PATL1_3  (351) VSIWGIPLLEDER----------------SDVILLKFLRARDFKVKEAFT
Arath_PATL1_2  (150) VKIWGIPLLEDDR----------------SDVVLLKFLRAREFKVKDSFA
  Brana_PATL_1   (1) --------------------------------------------------
Arath_PATL1_6  (327) --IWGVPLLKDDR----------------TDVVLLKFLRARDFKPQEAYS
  Helan_PATL_1   (1) --------------------------------------------------
  Glyma_PATL_3  (83) --IWGVPLFKDDR----------------TDVILLKFLRARELKVKDALV
Arath_PATL1_4   (67) SSMWGVSLLG----G-----------DDKADVILLKFLRARDFKVADSLR
Orysa_PATL1_2   (79) ISIWGVPLNPAPPQGGEGAPAPAAAADERADVVLLKFLRARDFRVRDAHA
  Zeama_PATL_1   (1) --------------------------------------------------
Arath_PATL1_5  (203) IELWGVPLLPSKGAE-------------STDVILLKFLRARDFKVNEAFE
Orysa_PATL1_4  (165) IALWGVPLLPSKGDD-------------ATDVVLLKFLRARDFKAGAAFD
Orysa_PATL1_1  (270) VLIWGVPLVGDDER---------------TDTVLLKFLRAREFKVKEAMA
  Zeama_PATL_3   (1) ------------------------------------------------MA
  Triae_PATL_2 (238) VFIWGVPLVGDDER---------------TDAVLLKFLRAREFKVKEAMA
Orysa_PATL1_3  (241) ELIWGVPLTGDDER---------------TDTVLLKFLRAREFKVKEAMA
  Triae_PATL_3   (1) ------------------------------------------------MA
  Zeama_PATL_2 (278) ELIWGVPLAGDDER---------------TDTVLLKFLRAREFKVKEAMA
  Glyma_PATL_1   (1) --------------------------------------------------
  Glyma_PATL_2 (267) VEIWGIPLLGDER----------------SDVILLKFLRARDFKVKEALN
     Consensus (401)    IWGVPLL DD                 TDVVLLKFLRARDFKVKEAM 451                                              500
Arath_PATL1_1  (276) MLKNTVQWRKENK-----IDELVE-SGEEVSEFEKMVFAHGVDKEGHVVI
Arath_PATL1_3  (385) MLKNTVQWRKENK-----IDDLVS-EDLEGSEFEKLVFTHGVDKQGHVVI
Arath_PATL1_2  (184) MLKNTIKWRKEFK-----IDELVE-EDLV-DDLDKVVFMHGHDREGHPVC
  Brana_PATL_1   (1) MLKNTVKWRREFK-----IDELVD-EDFV-DDLDKVVFMHGHDREGHPVC
Arath_PATL1_6  (359) MLNKTLQWRIDFN-----IEELLD-ENLG-DDLDKVVFMQGQDKENHPVC
  Helan_PATL_1   (1) --------------------------------------------------
  Glyma_PATL_3 (115) MFQNTLRWRKDFN-----IDALLD-EDLG-DHLEKVVFMHGHGREGHPVC
Arath_PATL1_4  (102) MLEKCLEWREEFK-----AEKLTEEDLGFKDLEGKVAYMRGYDKEGHPVC
Orysa_PATL1_2  (129) MLLRCAAWRAEFR-----ADAVLDEDLGFKDLEGVVAYMHGWDREGHPVC
  Zeama_PATL_1   (1) MVLRCAAWRAEFG-----ADAVLDEELGFKDLEGIVAYMHGWDRDGHPVC
Arath_PATL1_5  (240) MLKKTLKWRKQNK------IDSILGEEFG-EDLATAAYMNGVDRESHPVC
Orysa_PATL1_4  (202) MLRKTLHWRREWKGFAAGTDDDDDGEALP-AELADACYLDGADREGHPVC
Orysa_PATL1_1  (305) MLRSAVLWRKRFG-----IESLLD-ADLALPELDSVVFYRGADREGHPVC
  Zeama_PATL_3   (3) MLKSAVLWRKRFG-----ITSLLD-ADLGLPELENVVFYRGADREGHPVC
  Triae_PATL_2 (273) MLRSAVLWRKRFG-----IESLLE-ADLAFPELEKVVFYRGADREGHPVC
Orysa_PATL1_3  (276) MLKAAVLWRKRFG-----IDAVLA-ADLGLPELENVVFYRGADREGHPVC
  Triae_PATL_3   (3) MLKAAVLWRKSFG-----IDALLG-ADLGVPELENVVFYRGADREGHPVC
  Zeama_PATL_2 (313) MLKSAVLWRKRFG-----IDELLLDADLGLRELEGVVFYRGADREGHPVC
  Glyma_PATL_1   (1) MLKNTIQWRKEFG-----MEELME-EKLG-DELEKVVFMHGFDKEGHPVC
  Glyma_PATL_2 (301) MIRNTVRWRKEFG-----IEGLVE-EDLG-SDWEKVVFKDGYDKEGHPVY
     Consensus (451) MLK TV WRKEF       ID LLD EDLG  ELEKVVFM G DREGHPVC
```

FIGURE 2 (continued)

```
                        501                                              550
Arath_PATL1_1    (320)  YSSYGEFQNK----ELFSDKEKLNKFLSWRIQLQEKCVRAIDFSNPEAKS
Arath_PATL1_3    (429)  YSSYGEFQNK----EIFSDKEKLSKFLKWRIQFQEKCVRSLDFS-PEAKS
Arath_PATL1_2    (227)  YNVYGEFQNKELYNKTFSDEEKRKHFLRTRIQFLERSIRKLDFS-SGGVS
 Brana_PATL_1     (44)  YNVYGEFQNKELYNKTFSDEEKRKHFLRTRIQFLERSIRKLDFS-SGGVS
Arath_PATL1_6    (402)  YNVYGEFQNKDLYQKTFSDEEKRERFLRWRIQFLEKSIRNLDFV-AGGVS
 Helan_PATL_1      (1)  ---------------MFSDNEGRLRFLRWRIQYLERSIRKLDFR-PGGVN
 Glyma_PATL_3    (158)  YNVYGEFQNKDLYHKAFSSQDNRNKFLRWRIQLLERSIRHLDFTPSSGIN
Arath_PATL1_4    (147)  YNAYGVFKEKEMYERVFGDEEKLNKFLRWRVQVLERGVKMLHFK-PGGVN
Orysa_PATL1_2    (174)  YNAYGVFKDRDMYDRVFGDGERLARFLRWRVQVMERGVRALHLR-PGGVN
 Zeama_PATL_1     (46)  YNAYGVFKDRDMYERVFGDGDRLARFLRWRVQVMERGVRALTLR-PGGVN
Arath_PATL1_5    (283)  YN-----VHSEELYQTIGSEKNREKFLRWRFQLMEKGIQKLNLK-PGGVT
Orysa_PATL1_4    (251)  YNALGVFADDAVYKKALGTEEGKARFLRWRVRAMESHVAKLDLR-PGGVA
Orysa_PATL1_1    (349)  YNVYGEFQDKDLYEKAFSDEEKRERFLKWRIQLLERGILSQLDFSPSGIC
 Zeama_PATL_3     (47)  YNVYGEFQDKDLYEKAFGDDEKRERFLKWRIQLLERGILSKLDFSPNGIC
 Triae_PATL_2    (317)  YNVYGEFQDKEVYEKAFGDEEKRERFLKWRIQLLERGILSQLDFAPSGIC
Orysa_PATL1_3    (320)  YNVYGEFQDKDLYEKAFGDEEKRERFLKWRIQLLERGILDQLDFSPSGIC
 Triae_PATL_3     (47)  YNVYSEFQDKDLYEKAFGDDEKRERFLKWRIQLLERGIREQLDFSPSGIC
 Zeama_PATL_2    (358)  YNVYGEFQDKELYERAFGDEEKRERFLKWRIQLLERGIREQLDFSPSGIC
 Glyma_PATL_1     (44)  YNIYEEFQNKELYKKTFSDEEKREKFLRWRIQFLEKSIRKLDFN-PGGIC
 Glyma_PATL_2    (344)  YNVFGEFEDKELYSKTFLDEEKRNKFIRWRIQSLEKSVRSLDFS-PNGIS
    Consensus    (501)  YNVYGEFQDKDLY K FGDEEKR RFLRWRIQLLERGIR LDF  PGGI 551                                              600
Arath_PATL1_1    (366)  SFVFVSDFRNAPGLGKRALWQFIRRAVKQFEDNYPEFAAKELFINVPWWY
Arath_PATL1_3    (474)  SFVFVSDFRNAPGLGQRALWQFIKRAVKQFEDNYPEFVAKELFINVPWWY
Arath_PATL1_2    (276)  TIFQVNDMKNSPGLGKKELRSATKQAVELLQDNYPEFVFKQAFINVPWWY
 Brana_PATL_1     (93)  TIFQINDMKNSPGLGKKELRSATKQAVQLLQDNYPEFVFKQAFINVPWWY
Arath_PATL1_6    (451)  TICQVNDLKNSPGPGKTELRLATKQALHLLQDNYPEFVSKQIFINVPWWY
 Helan_PATL_1     (35)  TIFQISDLKNSPGPAKRELRLATRQALQILQDNYPEFVAKQVFINAPWWY
 Glyma_PATL_3    (208)  TIFQVNDLKNSPGPAKRELRLATKQALQLLQDNYPEFVAKQVFINVPWWY
Arath_PATL1_4    (196)  SIIQVTDLKDMP---KRELRVASNQILSLFQDNYPELVATKIFINVPWYF
Orysa_PATL1_2    (223)  AIIQVTDLKDMP---KRELRAASNQILSLFQDNYPEMVARKVFINVPWYF
 Zeama_PATL_1     (95)  AIIQVTDLKDMP---KRELRAASNQILSLFQDNYPEMVARKVFINVPWYF
Arath_PATL1_5    (327)  SLLQIHDLKNAPGVSRTEIWVGIKKVIETLQDNYPEFVSRNIFINVPFWF
Orysa_PATL1_4    (300)  SLLQVTDLKNSPGPAKKDLRVAMKQVLDLFQDNYPELVARNILINVPFWY
Orysa_PATL1_1    (399)  SMVQVTDLKNSP-PMLGKHRAVTRQAVALLQDNYPEFIAKKVFINVPWWY
 Zeama_PATL_3     (97)  SMVQVTDLKNSP-PMLGKHRAVTRQAVTLLQDNYPEFIAKKVFINVPWWY
 Triae_PATL_2    (367)  SMVQVTDLKNSP-PMLGKHRAVTRQAVALLQDNYPEFIAKKVFINVPWWY
Orysa_PATL1_3    (370)  SMVQVTDLKNSP-PMLGKHRTVTRQALALLQDNYPEFIAKKIFINVPWWY
 Triae_PATL_3     (97)  SMVQVTDLKNSP-PMLGKHRAVTRQALALLQDNYPEFIAKKVFINVPWWY
 Zeama_PATL_2    (408)  SMVQVTDLKNSP-PMLGKHRAVTRQALALLQDNYPEFVAKKVFINVPWWY
 Glyma_PATL_1     (93)  TIVHVNDLKNSPGLAKWELRQATKHALQLLQDNYPEFVAKQVFINVPWWY
 Glyma_PATL_2    (393)  TIVQVNDLKNSPGLGKRELRQATNQALQLLQDNYPEFVAKQIFINVPWWY
    Consensus    (551)  SIVQVTDLKNSPGPGKRELR ATKQAL LLQDNYPEFVAK VFINVPWWY
```

FIGURE 2 (continued)

```
                        601                                                        650
Arath_PATL1_1   (416)   IPYYKTFGSIITSPRTRSKMVLAGPSKSADTIFKYIAPEQVPVKYGGLS-
Arath_PATL1_3   (524)   IPYYKTFGSIITSPRTRSKMVLSGPSKSAETIFKYVAPEVVPVKYGGLS-
Arath_PATL1_2   (326)   LVFYTVIGPFMTP-RSKSKLVFAGPSRSAETLFKYISPEQVPVQYGGLSV
 Brana_PATL_1   (143)   LVFYTVIGPFMTP-RSKSKLVFAGPSRSAETLFKYISPEQVPVQYGGLSV
Arath_PATL1_6   (501)   LAFYRIISPFMSQ-RSKSKLVFAGPSRSAETLLKYISPEHVPVQYGGLSV
  Helan_PATL_1   (85)   LAFYTMISPFMTQ-RTKSKFVFASTAKTPETLFKYVNPEHVPIQYGGLSV
  Glyma_PATL_3  (258)   LAFYTMINPFLTS-RTKSKFVFAGPSKSPDTLFKYISPEQVPVQYGGLSV
Arath_PATL1_4   (243)   SVIYSMFSPFLTQ-RTKSKFVMSKEGNAAETLYKFIRPEDIPVQYGGLSR
 Orysa_PATL1_2  (270)   SVLFSMISPFLTE-RTKSKFVIAREGNVAETLFKFIRPELVPVQYGGLSR
  Zeama_PATL_1  (142)   SVLFSMISPFLTE-RTKSKFVIAREGNVAETLYKFIRPELVPVQYGGLSR
Arath_PATL1_5   (377)   YAMRAVLSPFLTQ-RTKSKFVVARPAKVRETLLKYIPADELPVQYGGFKT
 Orysa_PATL1_4  (350)   YAFSTLFYPFMTQ-RTKSKFVIARPSKVTETLLKYIPIEAIPVKYGGLKR
 Orysa_PATL1_1  (448)   LAANKMMSPFLTQ-RTKSKFIFASPAKSAETLFRYIAPEQVPVQFGGLFK
  Zeama_PATL_3  (146)   LAANKMMSPFFTQ-RTKSKFVFASPAKSAETLFRYIAPEQVPVQFGGLFK
  Triae_PATL_2  (416)   LAANKMMSPFLTQ-RTKSKFVFASQAKSPETLFRYIAPEQVPVQFGGLFK
 Orysa_PATL1_3  (419)   IAANKMVSPFLTQ-RTKSKIIFCTAAKSAETLFRYIAPEQVPVQFGGLYK
  Triae_PATL_3  (146)   LAANKMMSPFLTQ-RTKSKFTFCSPAKTAETLFRYIAPEQVPVQFGGLYK
  Zeama_PATL_2  (457)   LAANKVMSPFLTQ-RTKSKIVFCSPGKSAETLFRYIAPEQVPVQFGGLYK
  Glyma_PATL_1  (143)   LAVNRMISPFLTQ-RTKSKFVFAGPSKSTETLLRYIAPEQLPVKYGGLS-
  Glyma_PATL_2  (443)   LAFSRMISPFFTQ-RTKSKFVFAGPSKSADTLFRYIAPELVPVQYGGLSR
     Consensus  (601)   LA YKMISPFLTQ RTKSKFVFA PSKSAETLFKYIAPEQVPVQYGGLSK 651                                                        700
Arath_PATL1_1   (465)   ----KDTPLTEET--ITEAIVKPAANYTIELPASE-ACTLSWELRVLGAD
Arath_PATL1_3   (573)   ----KDSPFTVEDG-VTEAVVKSTSKYTIDLPATE-GSTLSWELRVLGAD
Arath_PATL1_2   (375)   DPCDCNPDFSLEDS-ASEITVKPGTKQTVEIIIYE-KCELVWEIRVTGWE
 Brana_PATL_1   (192)   DPCDCNPDFSLDDP-ASEVIVKPGTKQTVEIIIYE-KCEIVWEIRVIGWE
Arath_PATL1_6   (550)   DNCECNSDFTHDDI-ATEITVKPTTKQTVEIIVYE-KCTIVWEIRVVGWE
  Helan_PATL_1  (134)   DYCDCNPEFTIDDP-ASVVTVKPATKQTVEIIVNE-KCLFVWELRVVGWE
  Glyma_PATL_3  (307)   DFCDCNPDFTMSDP-VTEIPIKPTTKQTVEIAIYE-KCIIVWELRVVGWE
Arath_PATL1_4   (292)   ---PTDSQNGPPKP-ASEFSIKGGEKVNIQIEGIEGGATITWDIVGGWD
 Orysa_PATL1_2  (319)   ---AGDLENGPPKP-ASEFTIKGGEKVFLEIDGIEAGATITWDLVVGGWE
  Zeama_PATL_1  (191)   ---TGDLENGPPKP-ASEFTIKGGEKVFLEIDGIEAGATITWDLVVGGWD
Arath_PATL1_5   (426)   ---VDDTEFSNET--VSEVVVKPGSSETIEIPAPETEGTLVWDIAVLGWE
 Orysa_PATL1_4  (399)   ---DDDTEFSAEDSEVTELVVKASSTETIEIEATEGDTTLTWDLTVLGWE
 Orysa_PATL1_1  (497)   ---EDDPEFTTSDA-VTELTIKPSSKETVEIPVTE-NSTIGWELRVLGWE
  Zeama_PATL_3  (195)   ---EDDPEFTTLDT-VTELTIKPSSKETIEIPVTE-NSAIVWELRVLGWE
  Triae_PATL_2  (465)   ---EDDPDFTTSDS-VTELTIKASSKETIEIPVTE-NSTIVWELRVLGWE
 Orysa_PATL1_3  (468)   ---EDDTEFSTSDA-VTELPIKPSSKETVEIPATE-NSTVVWELRVLGWE
  Triae_PATL_3  (195)   ---EDDTEFSTSDG-VTELTVKPSSKETVEIPATE-NSTVVWELRVLGWE
  Zeama_PATL_2  (506)   ---EDDTEFSTSDA-VTELTVKPSSKETVEIPATE-NSTVVWELRVLGWE
  Glyma_PATL_1  (191)   ----KDGEFGNIDA-VTEITVRPAAKHTVEFSVTE-NCLLSWELRVIGWE
  Glyma_PATL_2  (492)   E---AEQEFTSAYP-VTEFTIKPATKHSVEFPVSE-KSHLVWEIRVVGWD
     Consensus  (651)      E D EFT D  VTELTVKPSSK TVEIPVTE  STIVWELRVLGWE
```

FIGURE 2 (continued)

```
                    701                                                   750
Arath_PATL1_1  (508) VSYGAQFEPTTEGSYAVIVSKTRKIGSTDEPVITDSFKVGEPGKIVITID
Arath_PATL1_3  (617) VSYGAQFEPSNEASYTVIVSKNRKVGLTDEPVITDSFKASEAGKVVITID
Arath_PATL1_2  (423) VSYKAEFVPEEKDAYTVVIQKPRKMRPSDEPVLTHSFKVNELGKVLLTVD
 Brana_PATL_1  (240) VSYKAEFVPEEKDAYTVVVQKPRKMKPFDEPVLTQSFKVNELGKVLLTVD
Arath_PATL1_6  (598) VSYGAEFVPENKEGYTVIIQKPRKMTAKNELVVSHSFKVGEVGRILLTVD
 Helan_PATL_1  (182) VSYSAEYVPNNESHYTIIIQKARKMTPTDEPVISHSFKISELGKILLTVD
 Glyma_PATL_3  (355) VSYNAEFKPDVEDAYTVIIQKATKMSPTDEPVVSNSFKVVELGKLLLTID
Arath_PATL1_4  (338) LEYSAEFVPNAEESYAIVVEKP-KKMKATDEAVCNSFTTVEAGKLILSVD
Orysa_PATL1_2  (365) LEYGAEYVPAAEDSYTLCVERTRKVPAAADEPVHNAFTAREAGKMVLSID
 Zeama_PATL_1  (237) LEYGAEYVPAAEDSYTLCVEKTRMVSATAEEPVHNAFTAREAGKMVLSID
Arath_PATL1_5  (471) VNYKEEFVPTEEGAYTVIVQKVKKMGAN-EGPIRNSFKNSQAGKIVLTVD
Orysa_PATL1_4  (446) VNYKEEFVPSEEGSYTVIVKKGKKMGSS-EAAVRNSFRAGEPGKVVLTVE
Orysa_PATL1_1  (542) VSYGAEFTPDAEGGYTVIVQKTRKVPANEEPIMKGSFKVGEPGKIVLTIN
 Zeama_PATL_3  (240) VSYSAEFTPDTEGGYTVIIQKTRKVPANEEPIMKGSFKVGEPGKLVLTVN
 Triae_PATL_2  (510) VSHGAEFTPDAEGAYTVIVQKTRKVPANEEPIMKGSFKAGEAGKIVLTVS
Orysa_PATL1_3  (513) VSYGAEFTPDAEGGYTVIVQKTRKVPANEEPIMKGSFKVGEPGKIVLTVD
 Triae_PATL_3  (240) VSYGVEFTPDAEGGYTVIVQKTRKVPANEEPIMKGSFKASEPGKVVLIVN
 Zeama_PATL_2  (551) VSYGAEFTPDAEGGYTVIVQKTRKVPAHEEPIMKGSFKATEPGKLVLGVN
 Glyma_PATL_1  (235) VSYGAEFVPSSEGSYTVIVQKARKVASSEEPVLCNSFKVGEPGKVVLTID
 Glyma_PATL_2  (537) VSYGAEFVPSAEDGYTVIVHKSRKIAPADETVLTNGFRIGEPGKIVLTID
    Consensus  (701) VSYGAEFVPDAEGSYTVIVQKTRKV A DEPVM  SFKV E GKIVLTVD 751                 779
Arath_PATL1_1  (558) NQTSKKKK-VLYRFKTQ------------
Arath_PATL1_3  (667) NQTFKKKK-VLYRSKTQA-----------
Arath_PATL1_2  (473) NPTSKKKK-LVYRFNVKPL----------
 Brana_PATL_1  (290) NPTSKKKK-LVYRFNVKPL----------
Arath_PATL1_6  (648) NPTSTKKM-LIYRFKVKPLACE-------
 Helan_PATL_1  (232) NPTSKKKT-LLYRFKVNPLSE--------
 Glyma_PATL_3  (405) NPTLKKKR-LLYRFKIKPYSD--------
Arath_PATL1_4  (387) NTLSRKKKVAAYRYTVRKSTTTV------
Orysa_PATL1_2  (415) NSGSRKRKVAAYRYFVRKPSA--------
 Zeama_PATL_1  (287) NSGSRKRKVAAYRYFVRKSSA--------
Arath_PATL1_5  (520) NVSGKKKK-VLYRYRTKTESSS-------
Orysa_PATL1_4  (495) NLTHRKKK-VLFRHKAKSACAKEC-----
Orysa_PATL1_1  (592) NPASKKKK-LLYRSKVKSTSESV------
 Zeama_PATL_3  (290) NPASKKKK-LLYRSKVKSISE--------
 Triae_PATL_2  (560) NAASKKKK-LLYRSKVKCSTGESVEADIP
Orysa_PATL1_3  (563) NAASKKKQLLYRFKVKSSSESA------
 Triae_PATL_3  (290) NPTSKKKK-LLCRFKVKSSTESSA-----
 Zeama_PATL_2  (601) NPASRKKK-LLCRFKVRSAAA--------
 Glyma_PATL_1  (285) NTSSKKKK-LLYRLKTKPSPSD-------
 Glyma_PATL_2  (587) NQTXKKKK-LLYRXQTKPIAE--------
    Consensus  (751) N TSKKKK LLYRFKVK  S
```

FIGURE 2 (continued)

SEQ ID NO: 01, DNA - Oryza sativa
ATGGCGGAGGAGCCACAGCCAGAGGCCGCGCCCGCCGCGGTGGCGGCGACGACCGAGGTGGCGGTG
GCGGAGAAGGCGCCCGTGGAGGCGGAGAAGGAGAAGAAGGTGGAGGAGGAGACGCCGGCGGTGGAG
GCCGAGGCGAAGGAGGAGAAGAAGGATGAGGCGGCGGCGGCGGCGGCGGCGGGAGGTGATGAGGCC
GGGGCGATAGAGGGGACCGGATCGTTCAAGGAGGAGAGCAACCTGGTGGCGGACTTGCCTGACCCG
GAGAAGAAGGCGCTCGATGAGTTCAAGCAGCTGATCGCCGCCGCCCTCGCCGCCTGTGAGTTCAAT
CTGCCTCCCCCTCCGCCGCCTCCCAAGGCGAAGGTTGAAGCCGCCGTTGAGGAGACCAAGGCGGAG
GAGACCAAGGCCGAGGAGGAACCCAAGGCTGAGGAGCCGGCCAAGGAGGAGGAGCCCAAGGCCGAG
GTGGCGGCGGCGGCGGCGGCGCCGCCGGAGGCAGGAACCGAGGAGCCGAAGGCGGAGGCGTCGTCC
GAAGAGGCCAAGACCGAGGAGCCGAAGGCCGAGGCGGCGGCCGACGAGCCGGCCAAGGAGGAGTCC
AAAGCTGAGGCGGCGCCGGCTGAGGAAGCCAAGCCGGCCGAGCCGGAGCCGGAGGAGAAGACCGTC
GTGGTCACCGAGGAAGAGGCGGCCACCAAGACGGTGGAAGCGATCGAGGAAACCGTCGTGCCCGCT
GCTGCTGCGCCTGCTGCCGCCGCCACGGAGGAAGCCGCGGCGCCGGAACCGGAGGTGCAGGCGGCG
GCGGCGCCTGAGCCCGTGTTGATCTGGGGCGTGCCCCTGGTAGGCGACGACGAGCGCACCGACACG
GTGCTCCTCAAGTTCCTGCGCGCGCGCGAGTTCAAGGTGAAGGAGGCCATGGCGATGCTCAGGTCG
GCCGTGCTGTGGCGCAAGCGCTTCGGCATCGAGTCCCTCCTCGACGCCGACCTCGCCCTGCCGGAG
CTCGACAGCGTGGTGTTCTACCGCGGCGCCGACCGCGAGGGCCACCCCGTGTGCTACAACGTCTAC
GGCGAATTCCAGGACAAGGACCTGTACGAGAAGGCATTCGGCGACGAGGAGAAGCGGGAGCGCTTC
CTCAAGTGGCGCATCCAGCTGCTGGAGCGCGGCATCCTGTCGCAGCTCGACTTCTCGCCCAGTGGC
ATCTGCTCCATGGTTCAGGTCACAGACCTCAAGAACTCGCCACCTATGCTCGGCAAGCACCGCGCC
GTCACCCGCCAGGCCGTTGCTCTGCTCCAGGACAACTACCCCGAGTTCATCGCCAAGAAGGTGTTC
ATCAATGTGCCATGGTGGTATCTCGCTGCCAACAAAATGATGAGCCCGTTCCTCACGCAGCGTACC
AAGAGCAAGTTCATTTTTGCCAGCCCAGCCAAATCAGCTGAGACCCTCTTCAGATATATCGCACCA
GAGCAAGTCCCTGTCCAATTCGGAGGTCTCTTCAAGGAAGATGATCCTGAGTTCACCACCTCAGAC
GCCGTTACCGAGCTCACTATCAAACCTTCATCGAAAGAAACCGTTGAGATTCCTGTCACTGAGAAT
TCCACGATTGGATGGGAGCTCCGGGTGCTTGGATGGGAGGTGAGCTACGGAGCAGAGTTCACTCCT
GATGCCGAGGGTGGATACACAGTCATCGTGCAGAAAACGAGGAAGGTGCCTGCAAATGAGGAACCA
ATCATGAAAGGCAGCTTCAAGGTTGGCGAGCCAGGAAAGATTGTGCTAACGATCAACAACCCTGCA
TCAAAGAAGAAGAAGCTCCTCTACAGATCCAAGGTCAAGAGCACCAGTGAGTCCGTTTGA

SEQ ID NO: 02, protein - Oryza sativa
MAEEPQPEAAPAAVAATTEVAVAEKAPVEAEKEKKVEEETPAVEAEAKEEKKDEAAAAAAAGGDEA
GAIEGTGSFKEESNLVADLPDPEKKALDEFKQLIAAALAACEFNLPPPPPPKAKVEAAVEETKAE
ETKAEEEPKAEEPAKEEEPKAEVAAAAAAPPEAGTEEPKAEASSEEAKTEEPKAEAAADEPAKEES
KAEAAPAEEAKPAEPEPEEKTVVVTEEEAATKTVEAIEETVVPAAAAPAAAATEEAAAPEPEVQAA
AAPEPVLIWGVPLVGDDERTDTVLLKFLRAREFKVKEAMAMLRSAVLWRKRFGIESLLDADLALPE
LDSVVFYRGADREGHPVCYNVYGEFQDKDLYEKAFGDEEKRERFLKWRIQLLERGILSQLDFSPSG
ICSMVQVTDLKNSPPMLGKHRAVTRQAVALLQDNYPEFIAKKVFINVPWWYLAANKMMSPFLTQRT
KSKFIFASPAKSAETLFRYIAPEQVPVQFGGLFKEDDPEFTTSDAVTELTIKPSSKETVEIPVTEN
STIGWELRVLGWEVSYGAEFTPDAEGGYTVIVQKTRKVPANEEPIMKGSFKVGEPGKIVLTINNPA
SKKKKLLYRSKVKSTSESV

SEQ ID NO: 03, DNA - Oryza sativa
ATGTCTCCGACCGCCACCCCATCCCCCGCGCCCGCCGCGGTGGCGGCAGCGCCCAAGCCGCCGCCG
TCGGGGACGGGGGCGAAGCGCAGCCTGATGTCGTCGCTGATGGAGGCCACCGCGCTGCTCAGGTCG
TCGTCGTTCAAGGAGGACTCGTACGTGGCGTCCGCGCTCCCGGCGTCCGACCTCCGCGCGCTCGCC
GACCTCAGGGCGCTGCTGTCCACGCACCCGGACCCAATCTCCATCTGGGGCGTGCCGCTCAACCCG
GCGCCGCCCCAGGGCGGGGAGGGGGCCCCGGCCCCGGCCGCCGCCGCCGACGAGCGCGCCGACGTC

FIGURE 5

```
GTGCTGCTCAAGTTCCTCCGCGCGCGGGACTTCCGCGTCCGCGACGCGCACGCCATGCTGCTCCGC
TGCGCCGCGTGGCGGGCCGAGTTCCGCGCCGACGCCGTGCTGGACGAGGACCTCGGGTTCAAGGAC
CTGGAGGGGGTCGTCGCCTACATGCACGGCTGGGACCGGGAGGGCCACCCGGTCTGCTACAACGCC
TACGGCGTCTTCAAGGACAGGGACATGTACGACCGCGTCTTCGGCGACGGCGAGCGCCTCGCCCGC
TTCCTCCGCTGGCGCGTCCAGGTCATGGAGCGCGGCGTCCGCGCGCTCCACCTCCGCCCCGGCGGC
GTCAACGCCATCATCCAGGTCACCGACCTCAAGGACATGCCCAAGCGCGAGCTCCGCGCCGCGTCC
AACCAGATCCTCTCCCTCTTCCAGGACAACTACCCTGAGATGGTCGCGCGCAAGGTGTTCATCAAC
GTGCCCTGGTACTTCTCGGTGCTGTTCTCCATGATCTCGCCGTTCCTCACGGAGCGCACCAAGAGC
AAGTTCGTCATCGCGCGCGAGGGCAACGTCGCCGAGACGCTCTTCAAGTTCATCCGGCCGGAGCTG
GTGCCGGTGCAGTACGGCGGGCTGAGCCGCGCCGGCGACCTGGAGAACGGCCCGCCGAAGCCGGCG
TCCGAGTTCACCATCAAGGGCGGCGAGAAGGTCTTCCTAGAGATCGACGGCATCGAGGCCGGCGCG
ACGATAACGTGGGACCTGGTGGTGGGCGGGTGGGAGCTGGAGTACGGCGCGGAGTACGTGCCGGCG
GCGGAGGACAGCTACACGCTGTGCGTGGAGCGGACGAGGAAGGTGCCGGCCGCCGCCGACGAGCCG
GTGCACAACGCCTTCACGGCGAGGGAGGCCGGCAAGATGGTGCTCTCCATCGACAACTCCGGCTCC
CGGAAGCGGAAGGTCGCCGCCTACCGGTACTTCGTGCGCAAGCCGTCGGCGTAG
```

SEQ ID NO: 04, protein - Oryza sativa
```
MSPTATPSPAPAAVAAAPKPPPSGTGAKRSLMSSLMEATALLRSSSFKEDSYVASALPASDLRALA
DLRALLSTHPDPISIWGVPLNPAPPQGGEGAPAPAAAADERADVVLLKFLRARDFRVRDAHAMLLR
CAAWRAEFRADAVLDEDLGFKDLEGVVAYMHGWDREGHPVCYNAYGVFKDRDMYDRVFGDGERLAR
FLRWRVQVMERGVRALHLRPGGVNAIIQVTDLKDMPKRELRAASNQILSLFQDNYPEMVARKVFIN
VPWYFSVLFSMISPFLTERTKSKFVIAREGNVAETLFKFIRPELVPVQYGGLSRAGDLENGPPKPA
SEFTIKGGEKVFLEIDGIEAGATITWDLVVGGWELEYGAEYVPAAEDSYTLCVERTRKVPAAADEP
VHNAFTAREAGKMVLSIDNSGSRKRKVAAYRYFVRKPSA
```

SEQ ID NO: 05, DNA - Oryza sativa
```
ATGGCTGAGGAGGCGAAGCAAGAGACCCCCGCCGCCGCCGAGGTGGTGGTGGTGGAGAAGGCCGAC
GAGGTGGTGGCGGTGGAGAAGGCCGTGGAGGTGGAGGCGGAGGAGAAGAAGTTGGCGGAGCAGGAG
GAGGAGGAGGAGAAGAAGGCGGAGGAGGCGGAGGAGGCCGCTGGGGGCGATGAGGCGGCGGTGATC
GAGGGGACGGGGTCGTTCAAGGAGGAGAGCAACCTCGTCTCCGAGCTCCCCGACCCGGAGCGCACG
GCGCTCGCCCAGCTCAAGGAGCTCGTCGCCGCCGCGCTTGCCGCCGGCGAGTTTGACCTTCCCCCG
CCGCCGCCGCCTCCACCGGCCAAGGCGGAGGAGCCGGCCAAGGAGGAGGAACCCAAGGCCGCCGAG
GCCCCCGCCGCCGAGGAGCCCAAGGCCGAGGCCGAGGCTGAGGCTGAGGCCGCCGCCACGGAGGAG
CCCAAGACCGAGGAGCCCAAGACCGAGGAGCCCGCCAAGGAGGAGGAGCCCAAGGCGGCGGCGGCG
GCTGCGGCCGAGGAGCCCAAGGCGGAGGCGGCGGCGGAGGAGGCCAAGCCGGCCGAGCCGGAAACG
GAGGAGAAGACCGTCGTGGTCACCGAGGATGAAGGCACCAGCAAGACGGTGGAGGCCATCGAGGAG
ACCGTCGTCGTCGCCGCCCCGGCCGCGGCCGCGGAAGCCGAGGCTGCGGCGCCGAAGGAGGAGCTG
ATATGGGGCGTGCCGCTGACCGGCGACGACGAGCGCACGGACACCGTGCTGCTCAAGTTCCTCCGC
GCCAGGGAGTTCAAGGTGAAGGAGGCCATGGCGATGCTCAAGGCGGCGGTGCTGTGGCGCAAGCGC
TTCGGCATCGACGCCGTCCTGGCCGCCGACCTCGGCCTGCCGGAGCTCGAGAACGTGGTGTTCTAC
CGCGGCGCCGACCGCGAGGGCCACCCCGTCTGCTACAACGTCTACGGCGAGTTCCAGGACAAGGAC
CTCTACGAGAAGGCCTTCGGCGACGAGGAGAAGCGGGAGCGATTCCTCAAGTGGCGCATCCAGCTC
CTCGAGCGCGGCATCCTCGACCAGCTCGACTTCTCCCCAGCGGCATCTGCTCCATGGTGCAGGTC
ACCGACCTCAAGAACTCGCCGCCCATGCTCGGCAAGCACCGCACCGTCACCCGCCAGGCGCTCGCC
CTGCTCCAGGACAACTACCCCGAGTTCATCGCCAAGAAGATTTTCATCAACGTGCCATGGTGGTAC
ATTGCGGCTAACAAAATGGTGAGTCCGTTCCTCACACAACGCACCAAGAGCAAGATCATCTTTTGC
ACCGCAGCCAAGTCTGCAGAGACCCTTTTCAGATACATTGCTCCTGAGCAAGTCCCTGTCCAATTC
GGAGGCCTCTACAAAGAGGATGACACCGAGTTCTCCACCTCAGATGCTGTCACAGAGCTTCCGATC
```

FIGURE 5 (continued)

```
AAACCTTCATCCAAAGAAACTGTTGAGATTCCTGCTACTGAGAACTCCACGGTTGTGTGGGAGCTT
CGGGTGCTTGGGTGGGAGGTGAGCTACGGTGCAGAGTTCACCCCTGATGCAGAGGGTGGCTACACT
GTCATTGTGCAGAAGACAAGGAAGGTGCCCGCCAATGAAGAGCCGATCATGAAGGGCAGCTTCAAG
GTTGGCGAGCCTGGCAAGATCGTCCTCACAGTCGACAACGCAGCATCCAAGAAGAAGAAGCAGCTT
CTTTACCGATTCAAGGTCAAGAGCTCCTCTGAATCTGCCTAA
```

SEQ ID NO: 06, protein - Oryza sativa
```
MAEEEAKQETPAAAEVVVVEKADEVVAVEKAVEVEAEEKKLAEQEEEEEKKAEEAEEAAGGDEAAVI
EGTGSFKEESNLVSELPDPERTALAQLKELVAAALAAGEFDLPPPPPPPAKAEEPAKEEEPKAAE
APAAEEPKAEAEAEAEAAATEEPKTEEPKTEEPAKEEEPKAAAAAAAEEPKAEAAAEEAKPAEPET
EEKTVVVTEDEGTSKTVEAIEETVVVAAPAAAAEAEAAAPKEELIWGVPLTGDDERTDTVLLKFLR
AREFKVKEAMAMLKAAVLWRKRFGIDAVLAADLGLPELENVVFYRGADREGHPVCYNVYGEFQDKD
LYEKAFGDEEKRERFLKWRIQLLERGILDQLDFSPSGICSMVQVTDLKNSPPMLGKHRTVTRQALA
LLQDNYPEFIAKKIFINVPWWYIAANKMVSPFLTQRTKSKIIFCTAAKSAETLFRYIAPEQVPVQF
GGLYKEDDTEFSTSDAVTELPIKPSSKETVEIPATENSTVVWELRVLGWEVSYGAEFTPDAEGGYT
VIVQKTRKVPANEEPIMKGSFKVGEPGKIVLTVDNAASKKKKQLLYRFKVKSSSESA
```

SEQ ID NO: 07, DNA - Oryza sativa
```
ATGGCGGTGGAGGTCGTGTCTGAGGGTGCGGCGGCCGCCGCGGCGGAGGTGGCGGCGCCGGAGACG
AAGGAGGTGACCGCGAAGGCGGCGGCGGATGAGGCGGTGACGCTGGCTGCCGTCGTGTCCAAGAAC
GCGTCGTTCAGGGAGGAGAGCAACTTCCTGGATGATCTCAAGGACGGCGAGAGGAAGGCGTTGGCT
GAGCTCCGTGCCAAGGTTGAGGAGGCCATCGTCGACGGCAAGCTGTTCGATGACGGCAAGGTGGAG
GCCAAGAAGAAGGCCGCGGCGGCGGAGGAGGAGAAGGCGGTGGAGGAGGCCGCCGGTGAGAAGAAA
GATGGCGAGGAGAAGAAGGAGGAGGAGGAGCCGGTGACGGAGGAGAAGAAGGAAGAGGAGCAAGGC
GAGGAGGAGGAGGAGCCCAAGAAAGAGGAAGCCGACGAGGGCGAGAAGGAGGAGAAGCCGGCGGAG
GAGGAGGCGGCGGCGGTTGTGGACAAGGACATCGCTCTGTGGGGCGTGCCGCTGCTGCCGAGCAAG
GGCGACGACGCCACCGACGTCGTCCTCCTCAAGTTCCTCCGCGCGCGCGACTTCAAGGCCGGCGCC
GCCTTCGACATGCTCCGCAAGACGCTCCACTGGCGCAGGGAGTGGAAGGGCTTCGCCGCCGGCACC
GACGACGACGACGACGGCGAGGCGCTCCCGGCGGAGCTCGCCGACGCGTGCTACCTCGACGGCGCG
GACAGGGAGGGCCACCCGGTGTGCTACAACGCGCTCGGCGTGTTCGCCGACGACGCCGTGTACAAG
AAGGCGCTCGGCACGGAGGAAGGCAAGGCGAGGTTCCTCCGGTGGAGGGTGCGCGCCATGGAGAGC
CACGTGGCCAAGCTCGACCTCAGGCCCGGCGGCGTCGCGTCGCTGCTGCAGGTGACGGACCTCAAG
AACTCGCCGGGGCCGGCCAAGAAGGACCTCCGCGTCGCCATGAAGCAGGTGCTCGACCTCTTCCAG
GACAACTACCCTGAGCTCGTCGCAAGAAACATTCTGATCAATGTGCCGTTCTGGTACTACGCGTTC
AGCACCCTCTTCTACCCGTTCATGACGCAGAGGACCAAGAGCAAGTTCGTCATTGCTCGGCCCTCC
AAGGTCACCGAGACCCTCCTCAAGTACATTCCCATTGAAGCCATTCCAGTGAAGTACGGTGGTCTG
AAGCGCGACGACGACACCGAGTTCTCGGCAGAGGACAGTGAAGTCACAGAGCTCGTTGTCAAGGCA
AGCTCCACCGAAACCATCGAGATCGAAGCCACAGAGGGTGACACTACGCTGACATGGACCTGACC
GTGCTGGATGGGAGGTGAACTACAAGGAGGAGTTCGTGCCGAGCGAGGAGGGCTCGTACACCGTC
ATCGTCAAGAAGGGGAAGAAGATGGGGTCGTCGGAGGCGGCGGTCCGCAACTCGTTCCGCGCCGGC
GAGCCGGGGAAGGTGGTCCTCACCGTCGAGAACCTGACGCACAGGAAGAAGAAGGTGCTGTTCAGG
CACAAGGCCAAGAGCGCCTGTGCCAAGGAGTGCTGA
```

SEQ ID NO: 08, protein - Oryza sativa
```
MAVEVVSEGAAAAAAEVAAPETKEVTAKAAADEAVTLAAVVSKNASFREESNFLDDLKDGERKALA
ELRAKVEEAIVDGKLFDDGKVEAKKKAAAAEEEKAVEEAAGEKKDGEEKKEEEEPVTEEKKEEEQG
EEEEEPKKEEADEGEKEEKPAEEEAAAVVDKDIALWGVPLLPSKGDDATDVVLLKFLRARDFKAGA
AFDMLRKTLHWRREWKGFAAGTDDDDDGEALPAELADACYLDGADREGHPVCYNALGVFADDAVYK
```

FIGURE 5 (continued)

KALGTEEGKARFLRWRVRAMESHVAKLDLRPGGVASLLQVTDLKNSPGPAKKDLRVAMKQVLDLFQ
DNYPELVARNILINVPFWYYAFSTLFYPFMTQRTKSKFVIARPSKVTETLLKYIPIEAIPVKYGGL
KRDDDTEFSAEDSEVTELVVKASSTETIEIEATEGDTTLTWDLTVLGWEVNYKEEFVPSEEGSYTV
IVKKGKKMGSSEAAVRNSFRAGEPGKVVLTVENLTHRKKKVLFRHKAKSACAKEC

SEQ ID NO: 09, DNA - Brassica napus
GCGACGTCGTTTTACTGAAGTTCCTACGCGCTAGGGACTTCAAGGTGAAAGATTCGCTGGCAATGC
TCAAGAACACAGTCAAGTGGAGAAGGGAGTTCAAGATCGACGAGTTGGTCGATGAAGACTTTGTGG
ATGATCTTGACAAGGTCGTGTTCATGCACGGACACGACCGTGAAGGCCACCCGGTGTGTTACAATG
TCTACGGCGAGTTCCAGAACAAGGAGCTTTACAACAAGACGTTCTCCGATGAGGAGAAGAGGAAGC
ATTTCTTGAGGACGAGGATTCAGTTCTTGGAGAGGAGTATAAGGAAGCTAGACTTCAGCTCCGGTG
GTGTTTCCACCATTTTTCAGATTAATGATATGAAGAACTCTCCGGGGTTGGGGAAGAAAGAGCTTA
GATCGGCGACCAAGCAAGCCGTGCAGTTGCTTCAGGACAATTACCCTGAGTTTGTCTTCAAACAGG
CCTTCATCAATGTTCCCTGGTGGTACCTTGTGTTTACACTGTGATTGGTCCGTTCATGACACCAA
GATCAAAGAGCAAGTTGGTGTTTGCTGGTCCGTCAAGATCAGCCGAAACTCTTTTCAAATACATAT
CGCCCGAACAAGTCCCGGTACAATACGGAGGATTGAGTGTAGATCCTTGTGACTGCAATCCAGACT
TCTCTTTGGATGATCCAGCCTCAGAGGTCATTGTTAAGCCTGGAACAAAGCAAACTGTTGAGATCA
TAATCTATGAGAAATGTGAGATTGTGTGGGAGATAAGGGTAATTGGATGGGAAGTGAGCTACAAGG
CAGAGTTTGTGCCTGAAGAGAAAGATGCTTATACGGTGGTTGTACAGAAACCGAGGAAGATGAAAC
CATTCGATGAACCGGTGTTAACCCAGAGCTTCAAAGTGAATGAGCTTGGCAAGGTTTTACTCACTG
TAGACAACCCAACCTCTAAGAAGAAGAAGCTCGTTTACAGGTTCAATGTCAAACCACTCTGAAGTG
AGATGTCTTCTTTGTGTTTTTGTATATGTGAGTGTTTGGTATATCATATCATATCATTTTGTATTT
GT

SEQ ID NO: 10, protein - Brassica napus
MLKNTVKWRREFKIDELVDEDFVDDLDKVVFMHGHDREGHPVCYNVYGEFQNKELYNKTFSDEEKR
KHFLRTRIQFLERSIRKLDFSSGGVSTIFQINDMKNSPGLGKKELRSATKQAVQLLQDNYPEFVFK
QAFINVPWWYLVFYTVIGPFMTPRSKSKLVFAGPSRSAETLFKYISPEQVPVQYGGLSVDPCDCNP
DFSLDDPASEVIVKPGTKQTVEIIIYEKCEIVWEIRVIGWEVSYKAEFVPEEKDAYTVVVQKPRKM
KPFDEPVLTQSFKVNELGKVLLTVDNPTSKKKKLVYRFNVKPL

SEQ ID NO: 11, DNA - Helianthus annuus
TCCCGCGTCGACGATTTCGTATGATCTTGAGAAAGTTGTGATTAATCATGGCTTTGATAAAGAAGG
ACACCCAGATTAATATAATGTGTATGGTGAGTTTCAGAACAAAGAGTTGTATAATAAAATGTTTAG
TGATAATGAAGGAAGATTGAGGTTTTTAAGGTGGAGAATTCAGTATCTTGAAAGGAGTATAAGGAA
GTTGGATTTTAGGCCTGGTGGGGTGAATACTATTTTTCAGATTAGTGATTTGAAGAACTCGCCTGG
ACCGGCGAAACGGGAGCTTCGGTTAGCCACCAGGCAAGCTCTGCAGATTCTGCAGGATAACTACCC
TGAATTTGTGGCAAAACAGGTTTTCATCAATGCCCCTTGGTGGTATTTAGCTTTCTATACAATGAT
TAGTCCATTCATGACTCAAAGGACTAAAAGCAAGTTTGTATTCGCTAGCACGGCCAAGACACCCGA
AACCCTTTTCAAATACGTGAATCCGGAGCACGTACCAATTCAGTACGGCGGGTTAAGCGTAGATTA
CTGCGATTGCAATCCCGAATTCACAATTGATGATCCGGCTTCAGTGGTCACCGTTAAACCAGCTAC
CAAGCAGACCGTGGAGATTATAGTAAACGAGAAATGCTTATTTGTATGGGAGCTACGTGTAGTCGG
TTGGGAGGTGAGCTATAGTGCTGAATATGTGCCGAACAACGAAAGCCATTACACGATAATCATACA
AAAGGCTAGAAAGATGACTCCAACCGATGAACCAGTGATCAGTCACAGTTTCAAGATCAGTGAGCT
TGGTAAGATACTTCTAACCGTCGACAACCCGACCTCCAAGAAGAAAACACTGCTCTATAGGTTCAA
GGTGAACCCGCTTTCCGAATAGAATAACGTACATCAAGGATCGACAGACAGACAGTCATATGATCG
CGCGAGTTTATTATTTATTTATGTTTTTATTTGTTTCTTTTGGTAGTTGTTATGAGTTTGGGTCC
ATGGTGTTGTGTTTGGGTTCAAAAGGCTTGTGGTTTTGTATTAATGTCTTTTGGCTTTCACAAAA
TCGGTTGCTGAAATTTGACTGATCGAGTTCTATTTT

FIGURE 5 (continued)

SEQ ID NO: 12, protein - Helianthus annuus
MFSDNEGRLRFLRWRIQYLERSIRKLDFRPGGVNTIFQISDLKNSPGPAKRELRLATRQALQILQD
NYPEFVAKQVFINAPWWYLAFYTMISPFMTQRTKSKFVFASTAKTPETLFKYVNPEHVPIQYGGLS
VDYCDCNPEFTIDDPASVVTVKPATKQTVEIIVNEKCLFVWELRVVGWEVSYSAEYVPNNESHYTI
IIQKARKMTPTDEPVISHSFKISELGKILLTVDNPTSKKKTLLYRFKVNPLSE

SEQ ID NO: 13, DNA - Zea mays
CGGCCGCGCTCCCGGCGTCCGAGCTCCGCGCGCTCGCCGACCTCAAGGCGCTGCTCGCCACCCACC
CGGACCCCATCTCCATCTGGGGCGTCCCGCTGAACCCTCGCTCCCCTCCCGCCGCGGCGGACGACG
CCGCCCCGGTCGACGAGCGCGCCGACGTGGTGCTCCTCAAGTTCCTCCGCGCGCGGGACTTCCGCG
TCCGCGACGCCCACGCCATGGTGCTCCGCTGCGCCGCCTGGCGCGCCGAGTTCGGCGCCGACGCCG
TGCTGGACGAGGAGCTGGGCTTCAAGGACCTGGAGGGCATCGTCGCCTACATGCACGGCTGGGACC
GCGACGGCCACCCCGTCTGCTACAACGCCTACGGCGTCTTCAAAGACAGGGACATGTACGAGCGCG
TCTTCGGCGACGGCGACCGCCTCGCGCGCTTCCTCCGCTGGCGCGTCCAGGTCATGGAGCGTGGCG
TGCGCGCGCTCACCCTGAGGCCCGGGGGCGTCAACGCCATCATACAGGTCACCGACCTCAAGGACA
TGCCAAAGCGGGAGCTCAGAGCCGCCAGCAACCAGATCCTCTCCCTCTTCCAGGACAACTACCCGG
AGATGGTAGCGCGGAAGGTGTTCATTAACGTGCCGTGGTACTTCTCCGTGCTCTTCTCCATGATCT
CGCCCTTCCTCACGGAGCGCACCAAGAGCAAGTTCGTCATCGCGCGCGAGGGCAACGTCGCCGAGA
CACTCTACAAGTTCATCCGGCCGGAGCTGGTGCCTGTGCAGTACGGCGGGCTGAGCCGCACCGGTG
ACCTCGAGAACGGACCACCGAAGCCGGCGTCCGAGTTCACCATCAAGGGTGGCGAGAAGGTCTTCC
TGGAGATCGACGGTATCGAGGCCGGTGCAACGATAACGTGGGATCTGGTCGTCGGGGGCTGGGACC
TCGAGTACGGAGCCGAGTACGTGCCGGCGGCCGAGGACAGCTACACGCTCTGCGTGGAGAAGACGA
GGATGGTCTCGGCCACCGCCGAGGAGCCCGTGCACAATGCCTTCACGGCTAGGGAAGCCGGCAAGA
TGGTGCTGTCCATAGACAATTCTGGTTCCCGGAAGCGCAAGGTTGCCGCCTACAGGTACTTCGTGC
GCAAGTCGTCGGCGTAGGCATGCTGATGTCTTGTGGTGGTCGTCGCGGCCGGCACCTTGCCGGCAG
GTAGCCGCGAGGGGGAGGTTAACGTGGAACAACTGGTGAAGTGTTTACTTGGGCTTGTGGGATTTG
GTGGGGAGAGGTCAAGTTAGGCTGTTTAATTATTAGTGCTATAACGACATGCATGTATTATGCCAT
ATGTAGAATATAATGTACTCCGTAAGAGCTGTTGCACTTTTGTCATCACCACTGTTATAAAGCTAA
TGATGAGTTAAGTTTTTTGGGCT

SEQ ID NO: 14, protein - Zea mays
MVLRCAAWRAEFGADAVLDEELGFKDLEGIVAYMHGWDRDGHPVCYNAYGVFKDRDMYERVFGDGD
RLARFLRWRVQVMERGVRALTLRPGGVNAIIQVTDLKDMPKRELRAASNQILSLFQDNYPEMVARK
VFINVPWYFSVLFSMISPFLTERTKSKFVIAREGNVAETLYKFIRPELVPVQYGGLSRTGDLENGP
PKPASEFTIKGGEKVFLEIDGIEAGATITWDLVVGGWDLEYGAEYVPAAEDSYTLCVEKTRMVSAT
AEEPVHNAFTAREAGKMVLSIDNSGSRKRKVAAYRYFVRKSSA

SEQ ID NO: 15, DNA - Glycine max
ACCATGCTGAAGAACACGATCCAGTGGAGGAAGGAGTTTGGGATGGAGGAGCTGATGGAAGAGAAG
CTCGGGGATGAGTTGGAGAAGGTGGTGTTCATGCACGGCTTTGACAAGGAGGGTCACCCTGTGTGT
TACAACATATATGAGGAGTTCCAGAACAAGGAGTTGTACAAGAAGACTTTTTCTGATGAGGAGAAG
AGGGAGAAGTTCCTGAGGTGGAGAATTCAGTTCCTGGAGAAGAGTATAAGGAAGCTTGATTTCAAC
CCTGGTGGCATATGCACCATTGTTCATGTTAATGACCTCAAGAACTCTCCTGGACTTGCCAAGTGG
GAACTTAGACAAGCCACCAAACATGCCCTACAATTGCTTCAAGACAATTACCCTGAATTTGTTGCC
AAACAGGTTTTTATTAATGTGCCTTGGTGGTACCTGGCAGTGAATAGGATGATAAGCCCTTTTCTT
ACTCAGAGGACTAAAAGCAAGTTTGTCTTTGCTGGGCCTTCCAAATCAACGGAAACCCTTTTGAGA
TACATAGCTCCGGAGCAGCTTCCCGTGAAGTACGGTGGACTAAGCAAAGATGGGGAGTTCGGAAAT
ATCGATGCTGTCACAGAAATCACAGTGAGGCCGGCAGCAAAACATACAGTGGAATTTTCAGTTACT FIGURE 5 (continued)

GAGAACTGCTTACTCTCTTGGGAGCTTAGAGTAATAGGATGGGAAGTAAGTTATGGCGCAGAATTT
GTGCCAAGCTCAGAAGGAAGCTACACAGTAATTGTCCAGAAGGCTAGGAAGGTTGCTTCATCAGAA
GAACCAGTTCTTTGCAACAGTTTTAAGGTTGGTGAACCTGGGAAAGTTGTTCTCACCATTGACAAC
ACAAGCTCTAAGAAGAAGAAGCTCTTGTATCGCTTGAAGACCAAGCCTTCCCCTTCTGACTAAAAT
CATCATTGTTATGTGTATGTGCAAGTGGGAAGGGGAAGAACAGTGCCAGAATTGTTTGCTTACATT
CCTGCATCAACTTCTACCAAGACACCAGTGCTTCAAAGATTAACTTTCCAGCTGTTCATATATGAA
TATAAAGTTTTTGTTTTAATTTTTTGGCCTTTTTGTTTTGATGATTATTATGTGTTCAACCATAT
TATATAATTATATATACCTCTTTCTGTGTTTTTCTTGC

SEQ ID NO: 16, protein - Glycine max
MLKNTIQWRKEFGMEELMEEKLGDELEKVVFMHGFDKEGHPVCYNIYEEFQNKELYKKTFSDEEKR
EKFLRWRIQFLEKSIRKLDFNPGGICTIVHVNDLKNSPGLAKWELRQATKHALQLLQDNYPEFVAK
QVFINVPWWYLAVNRMISPFLTQRTKSKFVFAGPSKSTETLLRYIAPEQLPVKYGGLSKDGEFGNI
DAVTEITVRPAAKHTVEFSVTENCLLSWELRVIGWEVSYGAEFVPSSEGSYTVIVQKARKVASSEE
PVLCNSFKVGEPGKVVLTIDNTSSKKKKLLYRLKTKPSPSD

SEQ ID NO: 17, DNA - Triticum aestivum
CCACGCGTCCGCTCTCCCCCTCTCCCTCCTGCTCTATCTTTCTCACCGCAAAAGCTTGAAACACCC
CGCGGAGATGGCAGAGGAGCCGCAGCCACAGGCCGCCGCCGCCCCGCCGCCGCGGCCACGGAGGT
GGTCGTCGCCGAGAAGGCGCCGGCGGAGGTGGAGAAGAAGGCCGAGGAGCCCGCGGCGGAGGCGGA
GGCCGAGGAGACGGCCGCCGTTGCCGACGACGGGGGCGCCGTCGAGGCCACCGGCTCTTTCAAGGA
GGAGAGCAACCTCGTCGCCGACCTGCCTGACCCGGAGAAGAAGGCGCTCGACGAGTTCAAGGAGCT
GATCGTCGCCGCGCTCGCCGCCGGTGAGTTCAATCTGCCCCCTCCCCGCCGCCGCCGAAGGCCAA
GACTGAGGCCGCCGCAGAGGAGACCAAGACGGAGGCGCCGGCCAAGGAGGAGGCCAAGACCGAGGA
GCCGGCCAAGGCGGAAGAACCAGCCAAGGAGGAGCCCAAGGCTGAAGAGCCGGCCAAGGCCGAGGC
GGCAGCGGCGGAGCCAGCAGCCGAGGAGCCCAAGGCCGTGGTCGCTGCCGAGGCAGCAGCCGAGGA
GCCGGCCAAGGAGGAACCCAAGGCCGAGGAGGCCAAGCCGGCCGAGCCAAAGAAGGAGGAGGAAGC
AGTCGTGGTCGCCGAGGAGGGCACCAAGACGGCGGAACCGGTCGAGGAGGCCGCCGCCGCCGCCAC
CACCACAGAGCAGGCAGCGGCGCCGGAACCGGAGGCGGAGGCAGCCGCGCCCGAGCCGGTGTTCAT
CTGGGGCGTGCCGCTGGTGGGCGACGACGAGCGCACGGACGCGGTGCTGCTCAAGTTCCTGCGCGC
GCGGGAGTTCAAGGTGAAGGAGGCGATGGCGATGCTCCGGTCCGCCGTGCTCTGGCGGAAGCGCTT
CGGCATCGAGTCGCTCCTGGAGGCGGACCTGGCCTTCCCGGAGCTGGAGAAGGTGGTGTTCTACCG
CGGCGCCGACCGGGAGGGCCACCCCGTCTGCTACAACGTGTACGGCGAGTTCCAGGACAAGGAGGT
GTACGAGAAGGCGTTCGGCGACGAGGAGAAGCGGGAGCGGTTCCTCAAGTGGCGCATCCAGCTGCT
GGAGCGCGGCATCCTGTCGCAGCTGGACTTCGCGCCCAGCGGCATCTGCTCCATGGTGCAGGTCAC
CGACCTCAAGAACTCGCCGCCCATGCTCGGCAAGCACCGCGCCGTCACCCGCCAGGCCGTCGCCCT
GCTCCAGGACAACTACCCCGAGTTCATCGCCAAGAAGGTGTTCATCAACGTGCCATGGTGGTATCT
CGCTGCCAACAAAATGATGAGCCCTTTCCTCACCCAGCGCACCAAGAGCAAGTTCGTGTTCGCCAG
CCAGGCCAAGTCACCCGAGACCCTCTTCAGATACATCGCGCCGGAGCAAGTCCCCGTCCAATTCGG
AGGCCTCTTCAAGGAAGATGACCCTGATTTCACCACCTCCGACTCTGTCACCGAGCTCACCATCAA
AGCTTCATCCAAAGAAACCATTGAGATCCCTGTCACCGAGAACTCAACGATTGTATGGGAGCTCCG
GGTGCTCGGCTGGAGGTCAGCCACGGCGCGGAGTTCACCCCCGACGCTGAGGGCGCGTACACCGT
CATCGTGCAGAAGACAAGGAAGGTCCCCGCGAATGAGGAGCCCATCATGAAGGGCAGCTTCAAGGC
CGGCGAGGCCGGCAAGATCGTGCTCACGGTCAGCAACGCCGCGTCGAAGAAGAAGAAGCTCCTCTA
CAGATCCAAGGTGAAGTGCAGCACCGGCGAGTCCGTTGAGGCCGACATTCCATGACCACCATTGGA
GTCAGTCCCTGATGATGATAGAAGAAGAAGAAGAAGAAGAAGATAAACCGCCTTTTTGGTTTTTGT
TCTTTGATTCCATTGGTTTTGTGGTTTTTGGTTCGCATTCCCGCATTTGTTTAATTATTAAAATTA
AAAACCCAAAGTGAGCTTGATTTTGTGACGGTACAGTAGTTGGGAGAGGAAGGTTGGTATGGATGG

FIGURE 5 (continued)

```
GATGATATAATGGCATCGTGATGGTTGTTGAGGGTAGGGCAAGAGGAGAAAAATGGATGATACAAT
CTGCTGCTGCTCTGTAAATTTGTCTGTACATTGTTGCAATCGCTGGCTGGATCCTCATGGACATGT
TATATTTAGAAGTACCTGCTGCCATCAAAAAAAC
```

SEQ ID NO: 18, protein - Triticum aestivum
```
MAEEPQPQAAAAPAAAATEVVVAEKAPAEVEKKAEEPAAEAEAEETAAVADDGGAVEATGSFKEES
NLVADLPDPEKKALDEFKELIVAALAAGEFNLPPPPPPPKAKTEAAAEETKTEAPAKEEEAKTEEPA
KAEEPAKEEPKAEEPAKAEAAAAEPAAEEPKAVVAAEAAAEEPAKEEPKAEEEAKPAEPKKEEEAVV
VAEEGTKTAEPVEEAAAAATTTEQAAAPEPEAEAAAPEPVFIWGVPLVGDDERTDAVLLKFLRARE
FKVKEAMAMLRSAVLWRKRFGIESLLEADLAFPELEKVVFYRGADREGHPVCYNVYGEFQDKEVYE
KAFGDEEKRERFLKWRIQLLERGILSQLDFAPSGICSMVQVTDLKNSPPMLGKHRAVTRQAVALLQ
DNYPEFIAKKVFINVPWWYLAANKMMSPFLTQRTKSKFVFASQAKSPETLFRYIAPEQVPVQFGGL
FKEDDPDFTTSDSVTELTIKASSKETIEIPVTENSTIVWELRVLGWEVSHGAEFTPDAEGAYTVIV
QKTRKVPANEEPIMKGSFKAGEAGKIVLTVSNAASKKKKLLYRSKVKCSTGESVEADIP
```

SEQ ID NO: 19, DNA - Triticum aestivum
```
GGTCCGGAATTTCCGGGTCGACCCACCCGTCCGGGAGGAGCCCAAGGCCGAGGAGGCCATCGAGGA
GACCGCCGTCCCCGCCGCGGCCGAGCCGGAGGCGGCGCCCGCCGCCGAGCCCAAGGAGGAGCTGAT
CTGGGGCGTGCCGCTGGTGGGCGGCGACGAGCGCACGGACACGGTGCTCCTCAAGTTCCTCCGCGC
GCGCGAGTTCAAGGTGAAGGAGGCCATGGCGATGCTCAAGGCGGCGGTGCTGTGGCGCAAGAGCTT
CGGCATCGACGCGCTCCTGGGCGCCGACCTCGGCGTGCCGGAGCTGGAGAACGTCGTCTTCTACCG
CGGCGCCGACCGCGAGGGCCACCCCGTCTGCTACAACGTCTACAGCGAGTTCCAGGACAAGGACCT
CTACGAGAAGGCCTTCGGCGACGACGAGAAGCGGGAGCGCTTCCTCAGGTGGCGCATCCAGCTCCT
CGAGCGCGGCATCCGGGAGCAGCTCGACTTCTCGCCCAGCGGCATCTGCTCCATGGTGCAGGTCAC
CGACCTCAAGAACTCGCCGCCCATGCTCGGCAAGCACCGCGCCGTCACCCGCCAGGCGCTCGCGCT
GCTCCAGGACAACTACCCTGAATTCATCGCCAAGAAGGTGTTCATCAATGTGCCATGGTGGTATCT
TGCGGCAAACAAGATGATGAGCCCATTCCTCACACAGCGCACCAAGAGCAAATTCACGTTTTGCAG
CCCAGCCAAGACCGCAGAGACCCTATTCAGATACATCGCGCCGGAGCAGGTCCCTGTCCAATTCGG
CGGCCTCTACAAAGAGGATGATACTGAATTCTCCACTTCTGATGGCGTGACCGAGCTCACTGTCAA
ACCTTCTTCCAAAGAAACTGTTGAGATTCCTGCTACTGAGAACTCCACGGTCGTGTGGGAGCTCCG
TGTGCTTGGATGGGAGGTGAGCTACGGCGTGGAGTTCACCCCGGACGCCGAGGGCGGCTACACGGT
CATCGTGCAGAAGACTCGGAAGGTGCCCGCCAACGAGGAGCCAATCATGAAGGGTAGCTTCAAAGC
GAGCGAGCCTGGCAAGGTGGTGCTCATCGTCAACAACCCGACGTCGAAGAAGAAGAAGCTGCTGTG
CCGATTCAAGGTGAAGAGCTCCACCGAATCCTCCGCCTGATGAGGTTCCAGCTGCTGATACAACCG
CCAACCAGGTCCATACCACCGCCACCATTTGAACATGTCGCATGATAGGGGAGAGCAAATAAGATT
TTAGTAGATGGCCGTTTTCGTGTCGGGTTCTTTGATTTGTTGGCTTGCTGTTTTTTGGGGGTCGGA
TTTGTATGTGTGTTTACTCGGAACCAAAGTGGGCTTGTTCTATGAATGAGATAGGTACTCCTGGCT
GGGATCC
```

SEQ ID NO: 20, protein - Triticum aestivum
```
MAMLKAAVLWRKSFGIDALLGADLGVPELENVVFYRGADREGHPVCYNVYSEFQDKDLYEKAFGDD
EKRERFLRWRIQLLERGIREQLDFSPSGICSMVQVTDLKNSPPMLGKHRAVTRQALALLQDNYPEF
IAKKVFINVPWWYLAANKMMSPFLTQRTKSKFTFCSPAKTAETLFRYIAPEQVPVQFGGLYKEDDT
EFSTSDGVTELTVKPSSKETVEIPATENSTVVWELRVLGWEVSYGVEFTPDAEGGYTVIVQKTRKV
PANEEPIMKGSFKASEPGKVVLIVNNPTSKKKKLLCRFKVKSSTESSA
```

SEQ ID NO: 21, DNA - Glycine max
GAAGCAACTCTTGTCTTCCCTTTCAACTTCAACTCAACCCTCAATCAAACTCATTCTGTCTTTTCT
TCTATTTTTATTTCTATCCAATCATCCATGGCCGAGGAACCCCAAAAACCAGCCTCCGCTGAAGAA
GTGGTCGCTGTTCCTGCGGAGAACCCACCATCTGAAGCCGAAGCTGAAAACATCGAAGCAGAGAAG
GCCCAGAGTGGTGTAGAAGACAAGATTTCCCAGTCGGTTTCGTTCAAGGAGGAGACCAACGTGGTT
GGCGACCTCCCCGAGGCGCAGAAGAAAGCCCTTGATGAGCTCAAGAAGCTTGTTCAAGAAGCGCTC
AACAACCATGAGCTAACTGCTCCCAAGCCAGAACCGGAGAAGAAGAAACCAGCAGCAGAGAAGAAG
GAGGAAGTTGAAGTGACAGAAGGGAAGAAGGAAGCTGAAGTCATAGAAGAGAAGAAGGAAGTGGAA
GTGACGGAAGAGAAGAAGGAAATTGAAGTAACAGAAGAGAAGAAGGAAGCTGAAGTCATAGAAGAG
AAGAAGGAAGTGGAAGTGACGGAAGAGAAGAAGGAAATTGAAGTAACAGAAGAGAAGAAGGAAGCA
GAAGTGAAAGAAGAGAAGAAGGAAGGGGAAGTGACGGAAGAGAAGAAGGAAGTTGAAGTGACGGAA
GAGAAGAAGGAAGCGGAAGTGATAGTAGAAGAGAAGAAGGAAGTTGAAGTGACGGAAGAGAAGAAG
GAAGTGGAAGTGACCGAAGGAAAGAAAGAAGTGGAAGTGATCGAAGAGAAGAAGGAAACAGAAGTG
ACAGAAGAAAAGAAAGAAGTGGAAGTAGAAGTGAGGGAAGAGAAGAAGGAAAGTGAAGTGAAAGAA
GAAGAAAAAGGTCGGGAGGTTGTTCCAGAGGAAGTTGAGATATGGGGAATTCCCCTGCTGGGGGAC
GAGAGGAGCGATGTGATTCTGCTAAAGTTTCTTAGGGCAAGGGATTTCAAGGTGAAGGAGGCCTTG
AACATGATAAGAAACACGGTGCGATGGAGAAAGGAATTTGGAATAGAGGGTCTAGTGGAGGAAGAT
CTTGGAAGTGATTGGGAGAAGGTGGTGTTCAAGGATGGATACGACAAAGAAGGGCACCCGGTGTAC
TACAACGTCTTTGGGGAGTTTGAGGACAAGGAGTTGTACAGCAAGACGTTTTTGGACGAGGAAAAG
AGGAACAAGTTCATAAGGTGGAGGATTCAGTCGTTGGAGAAGAGCGTTAGAAGCCTTGACTTCTCT
CCGAATGGGATATCGACAATAGTTCAGGTGAACGACCTTAAGAACTCTCCCGGACTGGGCAAGAGG
GAACTGAGGCAGGCCACCAATCAGGCCCTTCAACTGCTTCAGGACAACTACCCTGAGTTCGTTGCC
AAGCAGATATTCATCAATGTCCCCTGGTGGTACCTTGCCTTTTCTAGGATGATCAGTCCCTTCTTC
ACACAGAGGACCAAGAGTAAATTTGTTTTTGCTGGCCCTTCCAAATCTGCTGATACCCTTTTCAGA
TATATAGCTCCGGAGCTGGTCCCGGTTCAATACGGTGGTCTTAGCAGAGAGGCTGAACAGGAATTC
ACCTCTGCTTACCCTGTTACGGAGTTTACTATTAAACCCGCTACCAAACATTCTGTTGAGTTCCCT
GTTTCTGAGAAAAGCCATCTTGTTTGGGAAATCCGAGTGGTGGGTTGGGATGTCAGCTATGGAGCT
GAATTTGTGCCCAGCGCTGAGGATGGATACACTGTCATAGTACACAAGAGCAGGAAAATTGCTCCC
GCTGATGAGACCGTTCTTACCAACGGTTTCAGAATTGGTGAACCTGGCAAGATTGTACTCACCATA
GACAACCAAACATNCAAGAAGAAGAAACTNCTCTACAGGTNCCAGACCAAACCCATTGCAGAGTAA
GCTTGATNAGGATGNNTACTGNTACTGTATATTCATCATTACAACCANCACAACATNNGTGGTTGG
GCGAGGGACTTATTCTTTCATACGGNGTCTTCTTTTCT

SEQ ID NO: 22, protein - Glycine max
MAEEPQKPASAEEVVAVPAENPPSEAEAENIEAEKAQSGVEDKISQSVSFKEETNVVGDLPEAQKK
ALDELKKLVQEALNNHELTAPKPEPEKKKPAAEKKEEVEVTEGKKEAEVIEEKKEVEVTEEKKEIE
VTEEKKEAEVIEEKKEVEVTEEKKEIEVTEEKKEAEVKEEKKEGEVTEEKKEVEVTEEKKEAEVIV
EEKKEVEVTEEKKEVEVTEGKKEVEVIEEKKETEVTEEKKEVEVEVREEKKESEVKEEEKGREVVP
EEVEIWGIPLLGDERSDVILLKFLRARDFKVKEALNMIRNTVRWRKEFGIEGLVEEDLGSDWEKVV
FKDGYDKEGHPVYYNVFGEFEDKELYSKTFLDEEKRNKFIRWRIQSLEKSVRSLDFSPNGISTIVQ
VNDLKNSPGLGKRELRQATNQALQLLQDNYPEFVAKQIFINVPWWYLAFSRMISPFFTQRTKSKFV
FAGPSKSADTLFRYIAPELVPVQYGGLSREAEQEFTSAYPVTEFTIKPATKHSVEFPVSEKSHLVW
EIRVVGWDVSYGAEFVPSAEDGYTVIVHKSRKIAPADETVLTNGFRIGEPGKIVLTIDNQTXKKKK
LLYRXQTKPIAE

FIGURE 5 (continued)

SEQ ID NO: 23, DNA - Glycine max
GAAATGAAAGCTAAGGAAAGGAAGGGTAAAGGAGCGTAAAACTGGAGGAGTTTGTGTCTTGTTTTC
TTGTGGCGGGGCATAGGATTCCGAATAAATGCATGTTTCAACTTTCCTTTTTCTTCTCTCAGTCTC
TCTAGCTAGCTTTCTTCTCCACTCTCTCAAATGGCCCAAAATGATTCCAACCCTACTCCGCCTCCG
GAACCCCATGTAGCGGCGGAACCCATTACTGAGGATTTGGTCCAAGACAAAGAAGAAGAGGATGAT
AGTAGTAAGATTGTTATTCCAGTCCCAGAGAGCGAGTCCTTGTCATTGAAGGAGGATAGCAATAGG
GTTTCTGATTCCGAGAAAAATGCCATTGATGAGCTGAAGAAGCTCCTGAAAGAGGAATTAGAGGAC
GAGGAGGTTTCCATCTGGGGCGTCCCTCTCTTTAAGGATGACAGGACTGACGTCATTCTCCTCAAG
TTTCTCAGAGCTCGTGAGCTCAAAGTGAAGGACGCCCTTGTCATGTTTCAAAACACTCTCCGATGG
AGGAAGGACTTCAACATCGACGCCCTTCTGGATGAAGATCTGGGCGACCACTTGGAGAAGGTTGTC
TTCATGCACGGACACGGCAGAGAGGGCCATCCCGTCTGTTACAACGTCTACGGCGAGTTCCAGAAC
AAGGACCTCTACCACAAGGCCTTCTCCTCTCAGGATAATCGAAACAAGTTTCTCCGATGGCGTATT
CAGTTGTTGGAGCGCAGTATTCGGCACCTCGACTTCACTCCTTCCTCCGGCATCAACACCATTTTC
CAAGTCAATGACCTCAAAAACTCCCCTGGCCCTGCTAAACGTGAGCTTCGCCTTGCCACCAAACAA
GCTTTGCAGTTGCTTCAGGACAACTATCCCGAATTTGTTGCCAAACAGGTTTTTATCAACGTCCCA
TGGTGGTATCTTGCTTTCTATACCATGATCAATCCCTTCTTGACTTCGAGGACCAAAAGCAAATTT
GTCTTTGCTGGACCATCCAAGTCCCCCGATACTCTTTTCAAGTATATTTCTCCTGAGCAAGTGCCC
GTTCAGTATGGTGGCCTCAGTGTAGATTTCTGTGACTGCAACCCCGATTTCACTATGTCTGATCCT
GTCACCGAAATTCCTATAAAGCCTACCACTAAGCAAACTGTGGAAATTGCTATTTATGAGAAGTGC
ATTATTGTTTGGGAGCTGCGCGTGGTGGGCTGGGAGGTTAGCTACAATGCTGAATTCAAGCCTGAT
GTTGAAGATGCATATACGGTTATCATACAGAAGGCCACAAAGATGTCCCCCACCGATGAACCAGTT
GTTTCCAATAGCTTTAAAGTTGTTGAACTGGGAAAATTGTTGCTCACCATAGACAATCCTACCTTG
AAAAAAAAGAGGCTTCTTTACAGGTTCAAGATCAAACCCTACTCTGATTGAGAGAAAATAACCTCT
GGTGGTGGTTTTGGGTACATGAAGGAAATTGAACTTGAAGAGTAAGAAATATGCATGTCATCATTT
GTTCGGTCCATTTTTCATCTATAGTTTTGGTCGTGAGTTGTTTGCAGATTGTCTTTCTCTGTCTTT
GTTGGTTGGTGGGGTGTTTGAACACTTTATTGCTAGTCTAAATTGTTCTTTAATTTTC

SEQ ID NO: 24, protein - Glycine max
MAQNDSNPTPPPEPHVAAEPITEDLVQDKEEEDDSSKIVIPVPESESLSLKEDSNRVSDSEKNAID
ELKKLLKEELEDEEVSIWGVPLFKDDRTDVILLKFLRARELKVKDALVMFQNTLRWRKDFNIDALL
DEDLGDHLEKVVFMHGHGREGHPVCYNVYGEFQNKDLYHKAFSSQDNRNKFLRWRIQLLERSIRHL
DFTPSSGINTIFQVNDLKNSPGPAKRELRLATKQALQLLQDNYPEFVAKQVFINVPWWYLAFYTMI
NPFLTSRTKSKFVFAGPSKSPDTLFKYISPEQVPVQYGGLSVDFCDCNPDFTMSDPVTEIPIKPTT
KQTVEIAIYEKCIIVWELRVVGWEVSYNAEFKPDVEDAYTVIIQKATKMSPTDEPVVSNSFKVVEL
GKLLLTIDNPTLKKKRLLYRFKIKPYSD

SEQ ID NO: 25, DNA - Zea mays
TCCGCCCCGCCCTGTCGCTTTCCCTTCCACACGCGCCGTTCGCTTTGATCGACCAGGCAGGCATGG
CCGACGAGACGAAGCAAGAAGCCGCCGCCCCGGCGGCCGAGGTGGTCGTGACGGAGGAGGAGAAGA
AGGCAGAAGAGACCGCCCCGGTGGCGGAGGAAAAGGCCGTGGAGGCGGCTGTAGAGAAGGCCGCGG
AGGCGGAGGCGGGGGCCGAGGAAAAGGCCGCGGAAGCGGACTCGGAGGAGGAGAAGAAGGCGGAGG
AGGCCGAGGAGGCCGCCGCGGGCGATGAGGCGGCCGTGATCGATGGCACTGGGTCGTTCAAGGAGG
AGAGTAACCTGGTGTCCGAGCTCCCCGACCCTGAGCGCACAGCGCTCGCGCAGCTCAAGGAGCTCG
TCGCCACCGCGCTCGCTAACGGGGAGTTCAACCTGCCGCCGCCGCCTGCCAAGGAGGAGGCCAAGA
AGGAGGAGCCGGCAAAGGAAGAAGCTCCGGCGGACAAGGAGGACGAGCCCAAGGCAGAGGAGGCGG
CTGCCCAAGAGCCCGTCAAGGAGGAGGCCAAGCCTGAGGAGCCCAAAACGGAGGCGCCGGCGGAAG
CAGCGCCCGAGGAGGTTAAGGACGAGACACCCGTGCCGGAAGAGACCAAGACTGAGGCTCCCGCGC
CGGAGGAGCCCAAGGCCGAGGAGCCTGCCAAGGAGGAGCTCAAGGCAGAGGCGGCGACGGAAGCGG

```
TCGCCGAGGAGACCAAACCAGCTGAGCCGGTGCCGGAGGAGGAGGAGAAGACGGTCGTTGTTGCCG
AGGAGGAGGCCACCAAAACGGTGGAAGCCATCGAGGAGACGGTCGCCGTCGCCGTCGCCGCCGCCG
CGTCCGAGGAGCCCGAGGCGGGCGAGCCGAAGGAGGAGCTGATCTGGGGCGTGCCGCTGGCGGGCG
ACGACGAGCGCACGGACACGGTGCTGCTCAAGTTCCTCCGCGCGCGCGAGTTCAAGGTGAAGGAGG
CGATGGCGATGCTCAAGTCGGCGGTGCTGTGGCGCAAGCGGTTCGGCATCGACGAGCTCCTCCTGG
ACGCCGACCTCGGCCTGCGGGAGCTGGAGGGCGTGGTGTTCTACCGCGGCGCCGACCGCGAGGGCC
ACCCGGTCTGCTACAACGTGTACGGCGAGTTCCAGGACAAGGAGCTGTACGAGAGGGCCTTCGGCG
ACGAGGAGAAGCGGGAGCGCTTCCTCAAGTGGCGCATCCAGCTCCTGGAGCGCGGCATCCGGGAGC
AGCTCGACTTCTCGCCCAGCGGCATCTGCTCCATGGTGCAGGTCACCGACCTCAAGAACTCGCCGC
CCATGCTCGGCAAGCACCGCGCCGTCACGCGCCAGGCTCTCGCCCTGCTACAGGACAACTACCCGG
AGTTCGTGGCCAAGAAGGTGTTCATCAACGTGCCGTGGTGGTACCTGGCGGCAAACAAGGTGATGA
GCCCATTCCTGACTCAGCGCACCAAGAGCAAGATCGTCTTCTGCAGCCCTGGCAAGTCGGCGGAGA
CCCTCTTCAGATACATCGCCCCGGAGCAAGTCCCCGTCCAGTTCGGCGGCCTGTACAAGGAGGACG
ACACGGAGTTCTCCACCTCCGACGCCGTCACCGAGCTCACCGTGAAACCGTCCTCCAAGGAGACCG
TCGAGATCCCAGCCACCGAGAACTCCACCGTGGTGTGGGAGCTCCGCGTGCTGGGGTGGGAGGTGA
GCTACGGCGCCGAGTTCACCCCCGACGCGGAGGGCGGCTACACCGTCATCGTGCAGAAGACGCGGA
AGGTCCCCGCCCACGAGGAGCCCATCATGAAGGGCAGCTTCAAGGCCACGGAGCCCGGCAAGCTGG
TGCTGGGCGTGAACAACCCGGCGTCCAGGAAGAAGAAGCTGCTGTGCCGGTTCAAGGTGAGGAGCG
CCGCCGCCTGATGAGGGTCGTTGGTCTGGGTCCCAGCAGGTACAGCCTGCCAGCTGCTTGACCACC
AGCCCGACATGTATAATTCGATCGATCGCCAACCAGGTCCATACCGCCACCATTTGAATGAACATG
CTGCATTGCATTACATGATAGGAGAGAGAGAGAGAGAGAGAGAGGACAATAAAGAGTTTCTGCTTC
CTAGCTAGGCCCGTTCCGTGTCCTGGTCGTTCTTTGATTATTTGTTGGCTTGCTGTTCTTTTTTTT
CCTTGGGGGAGGGTCGCGTTTGTATGTGTTTATTACTTGAATGAAAACAAAAGTGAGCTTGTTAA
TGAAAAAAAAAAAAAAAAATGTTGAGGTCACCGTGGTCCGTGGTGGGGTGGGGAAGAAGAACAGT
AACAGTTGCTGCCCGGCCTGTACATTTCTTTCAAAAAAAAAAA
```

SEQ ID NO: 26, protein - Zea mays
```
MADETKQEAAAPAAEVVVTEEEKKAEETAPVAEEKAVEAAVEKAAEAEAGAEEKAAEADSEEEKKA
EEAEEAAAGDEAAVIDGTGSFKEESNLVSELPDPERTALAQLKELVATALANGEFNLPPPPAKEEA
KKEEPAKEEAPADKEDEPKAEEAAAQEPVKEEAKPEEPKTEAPAEAAPEEVKDETPVPEETKTEAP
APEEPKAEEPAKEELKAEAATEAVAEETKPAEPVPEEEEKTVVVAEEEATKTVEAIEETVAVAVAA
AASEEPEAGEPKEELIWGVPLAGDDERTDTVLLKFLRAREFKVKEAMAMLKSAVLWRKRFGIDELL
LDADLGLRELEGVVFYRGADREGHPVCYNVYGEFQDKELYERAFGDEEKRERFLKWRIQLLERGIR
EQLDFSPSGICSMVQVTDLKNSPPMLGKHRAVTRQALALLQDNYPEFVAKKVFINVPWWYLAANKV
MSPFLTQRTKSKIVFCSPGKSAETLFRYIAPEQVPVQFGGLYKEDDTEFSTSDAVTELTVKPSSKE
TVEIPATENSTVVWELRVLGWEVSYGAEFTPDAEGGYTVIVQKTRKVPAHEEPIMKGSFKATEPGK
LVLGVNNPASRKKKLLCRFKVRSAAA
```

SEQ ID NO: 27, DNA - Zea mays
```
CAACAATCTCTCTCCCCTCACTCCCTCTCTGCAGCGCGCAGCTTTCAAAGCGTTGGGAGAGATGGC
AGAGGAGACGCAACCAGAGGCCGCAGCCGCCGCCGCGCCCGCCGCGGCCGAGGTAGTCGTGACCGA
AGCTGCGCCGGCGGAGGCGGAGGTGCCTGTGGCGGCGGAAGCTGAAGCCGAGGCCAAGGATGAGAA
GAAAGGTGACGAGGCGGAGCTCACCGCCGATGACGCGGGGTGGGGACCGGCTCGTTCAAGGAGGA
AAGCAACCTGGTGGAAGACCTGCCCGACCCGGAGAAGAAGGCGCTCGACGAGTTCAAGCAGCTGAT
CGCTGCCGCCCTCGCCGCCGGTGAGTTCAACCTGCCTCCCCGCCGCCGCCGAAGGCCAAGGA
GACGAAGGTGGAGGAAGCCAAGGCCGAGGAGCCCGCCAAAGAAGAGCCCGCGGCCGAGGCGGAGGC
TACGGCGGAGGAGCCCAAGGCCCAGGTGGCTGCGGATGCCCCGGTTGAGGAGGTCAAGACGGAGGT
GCCGCCGGCCGAGGAGGCCAAGGCTGAGACACTGGCTGAGGAAGCCAAGCCTTCCGAGCCCGAGCC
```

GCAGGAGAAGACCGTCGTGGTCACTGAGGAGGAGACTGCCACCAAGACGGTGGAAGCAATCGAGGA
AACCGTCGTGTCCGCCCCCGCCGCCATCCCGGAGGAAGCAGCGGCGCCAGAGGCGGTGGTCGAGGC
TCAGGCGACCGCGCCTGAACCCGTGCTGATTTGGGGCGTGCCGCTGGTCGGCGACGACGAGCGCAC
GGACACGGTTCTGCTCAAGTTCCTGCGTGCGCGGGAGTTCAAGGTGAAGGATGCCATGGCGATGCT
CAAGTCCGCGGTGCTGTGGCGCAAGCGCTTCGGCATCACCTCGCTCCTCGACGCCGACCTCGGCCT
GACGGAGCTGGAGAACGTGGTGTTCTACCGCGGCACGGACCGCGAAGGCCACCCCGTGTGCTACAA
CGTCTACGGTGAGTTCCAGGACAAGGATCTCTACGAGAAGGCCTTCGGCGACGATGAAGAGGGA
GCGCTTCCTCAAGTGGCGCATCCAGCTGCTGGAGCGCGGCATTCTGTCGAAGCTGGACTTCTCGCC
CAGCGGCATCTGCTCCATGGTTCAGGTTACCGACCTCAAGAACTCGCCGCCTATGCTCGGCAAGCA
CCGCGCCGTCACCCGCCAGGCTGTCACGCTGCTCCAGGACAACTACCCCGAGTTCATTGCCAAGAA
GGTGTTCATCAATGTGCCGTGGTGGTATCTAGCCGCCAACAAGATGATGAGCCCGTTCCTCACACA
GCGCACCAAGAGCAAGTTCGTCTTTGCTAGCCCAGCCAAATCAGCAGCGACTCTATTCAGATACAT
CGCACCGGAACAAGTTCCTGTCCAATTTGGAGGCCTCTTCAAGGAGGATGATCCTGAGTTCACCAC
CTCTGACACTGTCTCCGAGCTCACTATCAAACCATCCTCAAAAGAAACCGTTGAGATCCCTGTCAC
CGAGAACTCCACAATTGTATGGGAACTCCGGGTGCTGAGTTGGGAAGTGAGCTATGGCGCCGAGTT
CACCCCCGACGCGGAGGGTGGGTACACCGTCATTGTACAGAAGACAAGGAAGGTGCCTGCTAACGA
GGAACCGATCATGAAGGGAAGCTTCAAGGCAGGCGAGCCTGGCAAACTTGTGCTAACTGTGAACAA
CCCTGCATCCAAGAAGAAGACGCTCCTTTACAGATCGAAGGTGAAGAGCACCAGCGAGTGAGTGTG
AGGTCACGCCGCTAGCTGCCTGGGCCCTACAGTTAAAACGATCTACAGCATGATAGAAGAGAAG
GAACCTTTTGGTTTGGTTCGTTAATTTACTGGGTTTTTTTTTGGGTTCGCATTCTACATTTTGTT
TGGTTGAAACCAAAGTGAGCTTGTTTTTGTGACAGTAGATGGGAGAAGTATAATGGCATTGTGTGA
TGGATGGTTGTTGATGAGGGCAGGGAGGACGAAAATGTGGGGAATGAAAGGTTGGAGAATGTCTG
TTCCTCTGTAGATGTGTTCTGTACATTGCATCTCTTGGATTCTCATTGATATGTTAAAATTTAGGA
GTACTTGGTCACATCATTATTCAATCCATGTTACTCTGC

SEQ ID NO: 28, protein - Zea mays
MAEETQPEAAAAAAPAAAEVVVTEAAPAEAEVPVAAEAEAEAKDEKKGDEAELTADDAGVGTGSFK
EESNLVEDLPDPEKKALDEFKQLIAAALAAGEFNLPPPPPPPKAKETKVEEAKAEEPAKEEPAAEA
EATAEEPKAQVAADAPVEEVKTEVPPAEEAKAETLAEEAKPSEPEPQEKTVVVTEEETATKTVEAI
EETVVSAPAAIPEEAAAPEAVVEAQATAPEPVLIWGVPLVGDDERTDTVLLKFLRAREFKVKDAMA
MLKSAVLWRKRFGITSLLDADLGLTELENVVFYRGTDREGHPVCYNVYGEFQDKDLYEKAFGDDEK
RERFLKWRIQLLERGILSKLDFSPSGICSMVQVTDLKNSPPMLGKHRAVTRQAVTLLQDNYPEFIA
KKVFINVPWWYLAANKMMSPFLTQRTKSKFVFASPAKSAATLFRYIAPEQVPVQFGGLFKEDDPEF
TTSDTVSELTIKPSSKETVEIPVTENSTIVWELRVLSWEVSYGAEFTPDAEGGYTVIVQKTRKVPA
NEEPIMKGSFKAGEPGKLVLTVNNPASKKKTLLYRSKVKSTSE

SEQ ID NO: 29, DNA - Saccharum officinarum
CGGACGCGTGGGCAAAACGGTGGAAGCCATCGAGGAGACCGCTGTCGCCTCCGCCGTGGCCGAACC
TGAGGCGGAGGCCGCGCCGGCGCCGGCGGCCGAGCCGAAGGAGGAGCTGATCTGGGGCGTGCCGCT
GGTGGGCGACGACGAGCGCACGGACACGGTGCTGCTCAAGTTCCTCCGCGCGCGCGAGTTCAAGGT
GAAGGAGGCCCTGGCGATGCTCAAGTCGGCGGTGCTGTGGCGCAAGCGCTTCGGCATCGACGAGCT
CCTGGGCGCCGACCTCGGCCTGCCGGAGCTGGAGAACGTGGTGTTCTACCGCGGCGCCGACCGCGA
GGGCCACCCCGTCTGCTACAACGTCTACGGCGAGTTCCAGGACAAGGAGCTCTACGAGAAGGCCTT
CGGCGACGAGGAGAAGCGGGAGCGCTTCCTCAAGTGGCGCATCCAGCTCCTCGAGCGCGGCATCAG
GGAGCAGCTCGACTTCTCGCCCAGTGGCATCTGCTCCATGGTGCAGGTCACCGACCTCAAGAACTC
GCCGCCCATGCTCGGCAAGCACCGCGCCGTCACACGCCAGGCTCTCGCCCTGCTCCAGGACAACTA
CCCCGAGTTCGTGGCCCAAGAGGTGTTTATCAATGTGCCATGGTGGTACCTCGCGGCGAAACAAGT
GATGAGCCCATTCNCTGACTCA

FIGURE 5 (continued)

SEQ ID NO: 30, protein - Saccharum officinarum
MLKSAVLWRKRFGIDELLGADLGLPELENVVFYRGADREGHPVCYNVYGEFQDKELYEKAFGDEEK
RERFLKWRIQLLERGIREQLDFSPSGICSMVQVTDLKNSPPMLGKHRAVTRQALALLQDNYPEFVA
QEVFINVPWWYLAAKQVMSPFXDS

SEQ ID NO: 31, DNA - Saccharum officinarum
CCTGGAGCAGCGTGACAGGACAACTACCCCGAGTTCATTGCCAAGAAGGTGTTCATCAATGTGCCG
TGGTGGTATCTCGCTGCCAACAAGATGATGAGCCCGTTCCTCACACAGCGCACCAAGAGCAAGTTC
GTTTTTGCTAGCCCAGCCAAGTCAGCAGAGACTCTATTCAGATACATCGCAGCGGAGCAAGTTCCT
GTCCAATTTGGAGGCCTCTTCAAGGAGGACGACCCTGAGTTCACCACCTCCGACACTGTCGCTGAG
CTCACTATCAAACCATCGTCAAAAGAAACCATTGAGATCCCTGTCACGGAGAACTCCACAATTGTA
TGGGAACTCCGGGTGCTCGGTTGGGAGGTGAGCTATGGTGCTGAGTTCACCCCTGACGCTGAGGGT
GGGTACACTGTCATTGTACAGAAAACAAGGAAGGTGCCCGCTAACGAGGAACCGATCATGAAGGGA
AGCTTCAAGGTACGCGAGCCCGGCAAACTTGTGCTAACTGTGAACAACTCGGCATCCAAGAAGAAG
AAGCTCCTTCACAGATCAAAGGTGAAGAGCACCANCGAGTGAGTGTGAGGTTGCTGCTANCTGCCT
GGGTCCTACAGTTAAACGATCTACCACAGTTAATCTCAGCATGATAGAAGAGAGGAAAAACCTTTT
GGTTTGGTTCGTTAATTTATTGGGTTTTGCTTGTTTTGGTGCACATTCTACATTTTGTTTGGTTAA
ACAAAAGTGAGCTTGTTTTTGGTTGATTNAAATNNATTTCCACTNNNAAAAAAAAAAAAAATAAAT
TTAAGGGGGGGCCGNTTTAAAAAGGGGGGGCCGTTCCTATAGGAA

SEQ ID NO: 32, protein - Saccharum officinarum
MMSPFLTQRTKSKFVFASPAKSAETLFRYIAAEQVPVQFGGLFKEDDPEFTTSDTVAELTIKPSSK
ETIEIPVTENSTIVWELRVLGWEVSYGAEFTPDAEGGYTVIVQKTRKVPANEEPIMKGSFKVREPG
KLVLTVNNSASKKKKLLHRSKVKSTXE

SEQ ID NO: 33, DNA - Saccharum officinarum
GCCTGAGCCCGTGCTGATCTGGGGCGTGCCGCTGGTGGGCGACGACGAGCGCACGGACACGGTTCT
GCTTAAGTTCCTGCGAGCGCGGGAGTTCAAGGTGAAGGAGGCCATTGCGATGCTCAAGTCCGCGGT
GCTGTGGCGCAAGCGCTTCGGCATCACCTCGCTCCTCGACGCCGACCTCGGCCTGCCGGAGCTGGA
GAACGTGGTGTTCTACCGCGGCGCCGACCGCGAGGGCCACCCCGTGTGCTACAACGTCTACGGCGA
GTTCCAGGACAAGGATCTCTACGAGAAGGCCTTCGGCGACGATGAGAAGCGGGAGCGCTTCCTCAA
GTGGCGCATCCAGCTGCTGGAGCGCGGCATCCTGTCGAAGCTGGACTTTTCGCCCAGCGGCATCTG
CTCCATGGTCCAGGTTACCGACCTCAAGAACTCGCCGCCCATGCTCGGCAAGCACCGCACCGTCAC
CCGCCAGGCTGTCACGCTGCTCCAGGACAACTACCCCGAGTTCATTGCCAAGAAGGTGTTCATTCA
ATGTGCCGTGGTGGTATCTCGCTGCCAACAAGATGATGAGCCCGTTCCTCACACAGCGCACCAAGA
GCAAGTTCGTTTTTGCTAGCCCAGCCAAGTCAGCAGAGACTCTATTCAGATACATCGCAGCGGAGC
AAGTTCCTGTCCAATTTGGAGGCCTCTTCAAGGAGGACGACCCTGAGTTCACCACCTCCGACACTG
TCGCTGAGCTCACTATCAAACCATCGTCAAAAGAAACCATTGAGATCCCTGTCACGGAGAACTCCA
CAATTGTATGGGAACTCCGGGTGCTCGGTTGGGAGGTGAGCTATGGTGCTGAGTTCACCCCTGACG
CTGAGGGTGGGTACACTGTCATTGTACAGAATACAAGGAAGGTGCCCGCTAACGAGGAACCGATCA
TGAAGGGAAGCTTCAAGGTAGGCGAGCCCGGCAAACTTGTGCTAACTGTGAACAAGCTAGCATCCA
ATAAGAAGAAGCTCCTTCACAGATCAAAGGTGAAGAGCACCANCGAGTGAGTGTGAAGTTGCTGCT
AGCTGGCTGGGTCCTACAGTTCAACGATCTACCACAGTTTATCTCAGCATGATAGAAGAAAGGAAA
AACCTTTTGGCTTGGGTCCGT

SEQ ID NO: 34, protein - Saccharum officinarum
MRSGSASSSGASSCWSAASCRSWTFRPAASAPWSRLPTSRTRRPCSASTAPSPARLSRCSRTTTPS
SLPRRCSFNVPWWYLAANKMMSPFLTQRTKSKFVFASPAKSAETLFRYIAAEQVPVQFGGLFKEDD
PEFTTSDTVAELTIKPSSKETIEIPVTENSTIVWELRVLGWEVSYGAEFTPDAEGGYTVIVQNTRK
VPANEEPIMKGSFKVGEPGKLVLTVNKLASNKKKLLHRSKVKSTXE

FIGURE 5 (continued)

SEQ ID NO: 35, DNA - Saccharum officinarum
CTCTCTCTTGCTCCTCTCCTCGCCACCGCCGCCGTGAAATCCGCACGCGTGCTGCGTCCTGCCGAG
TTGTGAGCTGTGATTGTGAGTGAGCGCCATGGCCGTGGAGGCTGTGTCTGGAAATGGCGCCGAGGC
GGTGGCGCCGGCGCCGGCGAAGGAGGTGAACGCCAAGGAGGCGGTTGCGGTGTCCAAGAACGCGTC
GTTCAGGGAGGAGAGCAACTTCCTGGACGATCTCAAGGAGAGCGAGCGTAAGGCGCTCGCCGAGCT
CCGCGACAAGGTCGAGGCGGCCATCGTGGAGGGCAAGCTGTTCGACGACGGCGGCAAGCCGGAGGC
GAAGGAGAAGGAGCAGGCCAAGAAGAAGGCTGAGAAGACCGTGGAGAAGAAAGAGGAGGAGCCCGA
AGCCGAAGAGAAGGGAGAGGAGGACGGCAAGAAGGAGGCCGACGCCGAGGAGGAGAAAAAGGAAGG
CGAGGAGGAAGGGGAGAAGAAGGACGACGAGGAGGGTGGAGGAGAAGACACCAAGGACGAGGCCAA
GAAAGATGAAGCCGGCGAGAAGGCGGCGGCGAAGGANGAGAAAGAGGANGAGAAGCCGGCGGAGAC
GGCGGCCGTCGTCGTCGTCGACAAGGACATCGCGCTGTGGGGCGTGCCTCTGCTCCCGAGCAAGGG
AGACGAGGCCACGGACGTGGTGCTCCTCAAGTTCCTCCGCGCGCGCGACTTCAAGGCCGGCGCCGC
GTTCGAGATGCTCCGCCGCACGCTCCGCTGGCGCAGGGGCTGGACCGGCTTCAGCGTTGACGCCGA
CGACGACGACGCCGACCTCCCCGAGGAGCTCGCGGGCGCGTGCTACCTCGACGGCGCGGACCGGGA
GGGCCACCCGGTGTGCTACAACGCGCCGGGCGTGTTCGCGGACGACGCCGTGTACAAGAAGGCGCT
GGGCACCGAGGAAGGCAAGGCCAGGTTCCTCCGGTGGCGGGTCCGCGCCATGGAGCGCCACGTGGC
CGAGCTGGACCTGAGGCCCGGCGGCGCCGCGTCGCTGCTGCAGGTGACCGACCTGAAGAACTCGCC
GGGCCCGGCCAAGAAGGACCTCCGCGTCGCCGTCAAGCAGGTGCTCGACCTGTTCCAGGACAACTA
CCCCGAGCTCGTCGCAAGAAACATCTTAATCAACGTGCCGTTCTGGTACTACGCGTTCAGCGCCCT
GTTCTACCCGTTCCTGACGCAGAGGACCAAGAGCAAGTTCGTCGTTGCTCGCCCGTCCAAGGTCAC
CGAGACCCTCCTCAAGTACATTCCGATTGAGGCCATCCCCGTGAAGTACGGCGGCCTGAAACGCGA
CGGCGACACCGAGTTCTTCGCGGACGACAGCGAAGTCACAGAAGGCACCGTCAAGGAAAGCTCCAC
GCAGACCATCGAGATCGA

SEQ ID NO: 36, protein - Saccharum officinarum
MAVEAVSGNGAEAVAPAPAKEVNAKEAVAVSKNASFREESNFLDDLKESERKALAELRDKVEAAIV
EGKLFDDGGKPEAKEKEQAKKKAEKTVEKKEEEPEAEEKGEEDGKKEADAEEEKKEGEEEGEKKDD
EEGGGEDTKDEAKKDEAGEKAAAKXEKEXEKPAETAAVVVVDKDIALWGVPLLPSKGDEATDVVLL
KFLRARDFKAGAAFEMLRRTLRWRRGWTGFSVDADDDDADLPEELAGACYLDGADREGHPVCYNAP
GVFADDAVYKKALGTEEGKARFLRWRVRAMERHVAELDLRPGGAASLLQVTDLKNSPGPAKKDLRV
AVKQVLDLFQDNYPELVARNILINVPFWYYAFSALFYPFLTQRTKSKFVVARPSKVTETLLKYIPI
EAIPVKYGGLKRDGDTEFFADDSEVTEGTVKESSTQTIEI

SEQ ID NO: 37, DNA - Triticum aestivum
CCACGCGTCCGCTCTCCCCCTCTCCCTCCTGCTCTATCTTTCTCACCGCAAAAGCTTGAAACACCC
CGCGGAGATGGCAGAGGAGCCGCAGCCACAGGCCGCCGCCGCCCCGCCGCCGCGGCCACGGAGGT
GGTCGTCGCCGAGAAGGCGCCGGCGGAGGTGGAGAAGAAGGCCGAGGAGCCCGCGGCGGAGGCGGA
GGCCGAGGAGACGGCCGCCGTTGCCGACGACGGGGCGCCGTCGAGGCCACCGGCTCTTTCAAGGA
GGAGAGCAACCTCGTCGCCGACCTGCCTGACCCGGAGAAGAAGGCGCTCGACGAGTTCAAGGAGCT
GATCGTCGCCGCGCTCGCCGCCGGTGAGTTCAATCTGCCCCCTCCCCGCCGCCGCCGAAGGCCAA
GACTGAGGCCGCCGCAGAGGAGACCAAGACGGAGGCGCCGGCCAAGGAGGAGGCCAAGACCGAGGA
GCCGGCCAAGGCGGAAGAACCAGCCAAGGAGGAGCCCAAGGCTGAAGAGCCGGCCAAGGCCGAGGC
GGCAGCGGCGGAGCCAGCAGCCGAGGAGCCCAAGGCCGTGGTCGCTGCCGAGGCAGCAGCCGAGGA
GCCGGCCAAGGAGGAACCCAAGGCCGAGGAGGCCAAGCCGGCCGAGCCAAAGAAGGAGGAGGAAGC
AGTCGTGGTCGCCGAGGAGGGCACCAAGACGGCGGAACCGGTCGAGGAGGCCGCCGCCGCCGCCAC
CACCACAGAGCAGGCAGCGGCGCCGGAACCGGAGGCGGAGGCAGCCGCGCCCGAGCCGGTGTTCAT
CTGGGGCGTGCCGCTGGTGGGCGACGACGAGCGCACGGACGCGGTGCTGCTCAAGTTCCTGCGCGC
GCGGGAGTTCAAGGTGAAGGAGGCGATGGCGATGCTCCGGTCCGCCGTGCTGTGGCGGAAGCGCTT FIGURE 5 (continued)

```
CGGCATCGAGTCGCTCCTGGAGGCCGACCTGGCCTTCCCGGAGCTGGAGAAGGTGGTGTTCTACCG
CGGCGCCGACCGGGAGGGCCACCCGGTGTGCTACAACGTGTACGGCGAGTTCCAGGACAAGGAGGT
GTACGAGAAGGCGTTCGGCGACGAGGAGAAGCGGGAGCGGTTCCTCAAGTGGCGCATCCAGCTGCT
GGAGCGCGGCATCCTGTCGCAGCTGGACTTCGCGCCCAGCGGCATCTGCTCCATGGTGCAGGTCAC
CGACCTCAAGAACTCGCCGCCCATGCTCGGCAAGCACCGCGCCGTCACCCGCCAGGCCGTCGCCCT
GCTCCAGGACAACTACCCCGAGTTCATCGCCAAGAAGGTGTTCATCAACGTGCCATGGTGGTATCT
CGCTGCCAACAAAATGATGAGCCCTTTCCTCACCCAGCGCACCAAGAGCAAGTTCGTGTTCGCCAG
CCAGGCCAAGTCACCCGAGACCCTCTTCAGATACATTGCGCCGGAGCAAGTTCCCGTCCAATTTGG
AGGCCTCTTCAAGGAAGATGACCCTGATTTCACCACCTCCGACTCTGTCACCGAGCTCACCATCAA
AGCTTCATCCAAAGAAACCATTGAGATCCCTGTCACCGAGAACTCAACGATTGTATGGGAGCTCCG
GGTGCTCGGCTGGGAGGTCAGCCACGGCGCGGAGTTCACCCCGGACGCCGAGGGGCGTACACCGT
CATCGTGC
```

SEQ ID NO: 38, protein - Triticum aestivum
```
MAEEPQPQAAAAPAAAATEVVVAEKAPAEVEKKAEEPAAEAEAEETAAVADDGGAVEATGSFKEES
NLVADLPDPEKKALDEFKELIVAALAAGEFNLPPPPPPPKAKTEAAAEETKTEAPAKEEAKTEEPA
KAEEPAKEEPKAEEPAKAEAAAAEPAAEEPKAVVAAEAAAEEPAKEEPKAEEAKPAEPKKEEEAVV
VAEEGTKTAEPVEEAAAAATTTEQAAAPEPEAEAAAPEPVFIWGVPLVGDDERTDAVLLKFLRARE
FKVKEAMAMLRSAVLWRKRFGIESLLEADLAFPELEKVVFYRGADREGHPVCYNVYGEFQDKEVYE
KAFGDEEKRERFLKWRIQLLERGILSQLDFAPSGICSMVQVTDLKNSPPMLGKHRAVTRQAVALLQ
DNYPEFIAKKVFINVPWWYLAANKMMSPFLTQRTKSKFVFASQAKSPETLFRYIAPEQVPVQFGGL
FKEDDPDFTTSDSVTELTIKASSKETIEIPVTENSTIVWELRVLGWEVSHGAEFTPDAEGAYTVIV
```

SEQ ID NO: 39, DNA - Arabdidopsis thaliana
```
ATGGCTCAAGAGGAAGTACAGAAATCGGCTGATGTCGCTGCTGCTCCGGTGGTGAAGGAGAAACCT
ATTACCGATAAGGAGGTTACTATTCCTACCCCTGTGGCAGAGAAGAGGAAGTTGCTGCTCCTGTC
TCTGATGAGAAGGCGGTTCCAGAGAAGGAGGTGACTCCGGAGAAGGAAGCCCCAGCGGCGGAAGCG
GAGAAATCTGTTTCGGTGAAGGAGGAAGAGACGGTTGTTGTAGCTGAGAAGGTTGTTGTTTTAACT
GCTGAGGAAGTTCAGAAGAAGGCACTTGAGGAGTTTAAGGAGCTTGTAAGGGAGGCTTTGAACAAA
CGTGAATTCACTGCTCCGGTGACGCCGGTTAAGGAAGAGAAAACAGAGGAGAAGAAAACAGAGGAG
GAAACTAAGAGGAAGAGAAAACAGAGGAGAAGAAAGAAGAGACAACGACTGAGGTTAAGGTTGAA
GAAGAGAAACCGGCGGTTCCAGCGGCGGAGGAGGAGAAATCATCAGAGGCTGCTCCGGTTGAGACC
AAATCTGAGGAGAAACCTGAAGAGAAGCAGAGGTAACAACCGAGAAAGCATCCAGTGCCGAAGAA
GATGGAACCAAGACCGTGGAAGCAATCGAAGAATCTATCGTCTCTGTTTCACCACCTGAATCCGCC
GTAGCACCTGTCGTGGTAGAGACTGTCGCCGTTGCTGAGGCAGAGCCAGTGGAGCCGGAAGAAGTC
TCGATCTGGGGAGTTCCACTACTCCAAGACGAGAGATCTGACGTGATCCTCACGAAATTCCTCCGT
GCAAGAGACTTTAAGGTCAAAGAAGCTTTAACCATGCTTAAAAACACCGTCCAGTGGCGTAAAGAA
AACAAAATCGACGAACTCGTTGAATCCGGAGAAGAAGTGAGTGAGTTCGAGAAGATGGTGTTTGCT
CACGGTGTTGACAAGAAGGACACGTCGTGATCTACAGTTCTTACGGTGAGTTTCAGAACAAGGAG
CTTTTCTCCGACAAGGAGAAGCTTAACAAGTTCCTCAGCTGGAGGATTCAGCTACAAGAGAAGTGT
GTGAGAGCTATTGATTTCAGCAACCCTGAAGCGAAGTCTTCGTTTGTGTTCGTCAGCGACTTCAGG
AACGCTCCAGGACTTGGTAAAAGAGCCTTGTGGCAATTCATCAGACGCGCTGTTAAACAATTCGAG
GACAATTATCCTGAATTCGCCGCTAAAGAGCTATTCATCAATGTCCCATGGTGGTACATTCCATAC
TACAAAACATTCGGATCTATCATCACATCCCCAAGGACTAGGAGCAAGATGGTCCTTGCTGGTCCA
TCCAAATCTGCCGATACTATTTTCAAATACATAGCTCCTGAACAAGTTCCCGTTAAATACGGTGGA
CTTAGCAAAGATACTCCTTTGACCGAAGAAACCATAACGGAAGCCATCGTTAAACCGGCAGCAAAC
TACACTATTGAATTGCCTGCTTCTGAGGCTTGCACGCTTTCATGGGAGCTTAGGGTTTTGGGTGCT
```

FIGURE 5 (continued)

```
GATGTGAGCTACGGAGCTCAGTTTGAGCCAACCACCGAAGGAAGCTATGCTGTGATCGTCTCTAAG
ACACGGAAGATTGGATCAACCGATGAACCGGTGATAACCGATTCTTTTAAGGTGGGTGAACCGGGA
AAGATTGTGATCACAATCGACAACCAGACTTCCAAGAAGAAGAAAGTGCTCTACAGGTTCAAAACT
CAATAA
```

SEQ ID NO: 40, protein - Arabdidopsis thaliana
```
MAQEEVQKSADVAAAPVVKEKPITDKEVTIPTPVAEKEEVAAPVSDEKAVPEKEVTPEKEAPAAEA
EKSVSVKEEETVVVAEKVVVLTAEEVQKKALEEFKELVREALNKREFTAPVTPVKEEKTEEKKTEE
ETKEEEKTEEKKEETTTEVKVEEEKPAVPAAEEEKSSEAAPVETKSEEKPEEKAEVTTEKASSAEE
DGTKTVEAIEESIVSVSPPESAVAPVVVETVAVAEAEPVEPEEVSIWGVPLLQDERSDVILTKFLR
ARDFKVKEALTMLKNTVQWRKENKIDELVESGEEVSEFEKMVFAHGVDKEGHVVIYSSYGEFQNKE
LFSDKEKLNKFLSWRIQLQEKCVRAIDFSNPEAKSSFVFVSDFRNAPGLGKRALWQFIRRAVKQFE
DNYPEFAAKELFINVPWWYIPYYKTFGSIITSPRTRSKMVLAGPSKSADTIFKYIAPEQVPVKYGG
LSKDTPLTEETITEAIVKPAANYTIELPASEACTLSWELRVLGADVSYGAQFEPTTEGSYAVIVSK
TRKIGSTDEPVITDSFKVGEPGKIVITIDNQTSKKKKVLYRFKTQ
```

SEQ ID NO: 41, DNA - Arabdidopsis thaliana
```
ATGGCTGAAGAACCTACTACTACCACTCTCGTTACACCGGAAAAGCTACCTTCTCCGAGCCTCACG
CCTTCTGAAGTATCTGAATCTACTCAAGATGCCCTACCGACAGAGACAGAAACTCTGGAGAAAGTG
ACTGAGACTAATCCACCGGAAACTGCAGATACCACCACCAAGCCAGAAGAAGAAACCGCGGCAGAG
CATCATCCACCGACAGTGACGGAAACAGAAACTGCATCGACGGAGAAACAAGAGGTTAAAGACGAA
GCATCGCAGAAAGAAGTAGCTGAAGAGAAAAAGAGTATGATTCCACAGAATCTTGGTTCATTCAAA
GAAGAAAGCAGCAAACTTTCTGATCTATCTAATTCCGAGAAGAAATCACTCGATGAACTAAAACAT
CTAGTTCGAGAAGCTCTAGACAATCACCAATTCACCAACACACCAGAAGAAGTCAAGATTTGGGGG
ATTCCATTACTTGAAGACGATAGAAGCGACGTCGTTTGTTAAAATTCCTAAGAGCTAGGGAGTTC
AAGGTGAAAGATTCGTTTGCTATGCTCAAGAACACAATCAAGTGGAGAAAGGAGTTCAAGATCGAT
GAATTGGTCGAGGAAGATCTTGTGGATGATCTTGACAAGGTTGTGTTTATGCATGGACATGACCGA
GAAGGTCACCCTGTTTGTTACAATGTCTATGGTGAGTTTCAGAACAAGGAGCTTTATAATAAGACG
TTTTCTGATGAGGAAAGAGGAAACATTTCTTGAGGACTAGGATTCAGTTCTTGGAGAGGAGTATA
AGGAAGCTAGATTTTAGCTCTGGTGGGGTTTCTACTATTTTTCAGGTTAATGATATGAAGAATTCT
CCGGGGGTTAGGGAAGAAAGAGCTTAGATCAGCTACTAAGCAAGCTGTTGAGTTGCTTCAGGACAAT
TACCCTGAGTTTGTCTTCAAACAGGCTTTTATCAATGTTCCTTGGTGGTACCTTGTGTTTTATACT
GTGATTGGTCCGTTCATGACACCAAGATCAAAGAGCAAGCTTGTGTTTGCTGGTCCTTCGCGTTCA
GCTGAAACCCTATTCAAATACATATCACCCGAGCAAGTTCCAGTACAATATGGTGGATTGAGTGTT
GATCCTTGCGACTGCAATCCAGACTTTTCGTTGGAAGATTCAGCCTCTGAGATCACTGTTAAGCCC
GGAACAAAACAAACTGTTGAGATCATAATCTATGAGAAATGTGAACTTGTGTGGGAGATAAGGGTA
ACTGGATGGGAAGTGAGCTACAAGGCTGAATTTGTGCCGGAAGAGAAAGATGCTTACACGGTGGTT
ATACAAAAACCGAGGAAGATGAGACCATCCGATGAACCGGTGTTAACCCATAGCTTCAAAGTGAAT
GAGCTTGGCAAGGTTTTACTCACAGTAGACAACCCAACCTCTAAGAAGAAGAAGCTCGTTTACAGG
TTCAATGTCAAACCTCTCTAA
```

SEQ ID NO: 42, protein - Arabdidopsis thaliana
```
MAEEPTTTTLVTPEKLPSPSLTPSEVSESTQDALPTETETLEKVTETNPPETADTTTKPEEETAAE
HHPPTVTETETASTEKQEVKDEASQKEVAEEKKSMIPQNLGSFKEESSKLSDLSNSEKKSLDELKH
LVREALDNHQFTNTPEEVKIWGIPLLEDDRSDVVLLKFLRAREFKVKDSFAMLKNTIKWRKEFKID
ELVEEDLVDDLDKVVFMHGHDREGHPVCYNVYGEFQNKELYNKTFSDEERKHFLRTRIQFLERSI
RKLDFSSGGVSTIFQVNDMKNSPGLGKKELRSATKQAVELLQDNYPEFVFKQAFINVPWWYLVFYT
VIGPFMTPRSKSKLVFAGPSRSAETLFKYISPEQVPVQYGGLSVDPCDCNPDFSLEDSASEITVKP
GTKQTVEIIIYEKCELVWEIRVTGWEVSYKAEFVPEEKDAYTVVIQKPRKMRPSDEPVLTHSFKVN
ELGKVLLTVDNPTSKKKKLVYRFNVKPL
```

FIGURE 5 (continued)

SEQ ID NO: 43, DNA - Arabdidopsis thaliana
ATGGCTCAAGAAGAGATACAGAAACCTACTGCCTCTGTTCCAGTGGTTAAGGAGGAAACTCCTGCC
CCGGTTAAGGAGGTTGAGGTGCCGGTTACTACGGAGAAAGCTGTGGCTGCGCCTGCTCCGGAAGCT
ACGGAGGAGAAAGTTGTGTCTGAGGTGGCGGTGCCTGAAACAGAGGTGACGGCGGTGAAAGAGGAG
GAGGTTGCGACGGGAAAGGAGATCTTGCAATCGGAGTCGTTTAAGGAGGAAGGCTATTTGGCTTCT
GAATTACAGGAAGCTGAGAAGAATGCTTTGGCTGAGTTAAAGGAGTTGGTTAGGGAGGCTTTGAAC
AAGCGTGAATTCACCGCGCCACCGCCACCACCAGCTCCGGTAAAGGAAGAGAAAGTTGAGGAGAAG
AAAACAGAGGAAACAGAGGAAAAGAAGGAAGAAGTTAAAACAGAGGAAAAATCTCTTGAGGCTGAA
ACCAAAGAAGAGGAGAAATCTGCTGCTCCGGCCACCGTAGAGACCAAGAAAGAAGAGATCTTGGCC
GCTCCGGCTCCGATCGTCGCAGAGACCAAGAAGGAAGAGACACCAGTTGCTCCTGCTCCGGTAGAG
ACTAAACCGGCTGCTCCGGTCGTTGCAGAGACAAAGAAGGAAGAAATATTACCAGCTGCTCCGGTC
ACCACAGAGACCAAGGTGGAAGAGAAAGTCGTTCCAGTAGAAACCACACCGGCTGCTCCAGTCACC
ACAGAGACCAAGGAAGAAGAGAAAGCCGCTCCGGTCACCACAGAGACCAAGGAGGAAGAGAAAGCA
GCTCCGGGAGAGACCAAGAAAGAAGAGAAAGCAACCGCCTCTACTCAGGTCAAGAGGGCCTCAAAA
TTTATTAAAGATATATTTGTCTCAGTCACCACTAGCGAGAAGAAGAAGGAAGAAGAGAAACCAGCA
GTAGTAACAATCGAGAAGGCTTTCGCAGCTGATCAAGAAGAAGAAACAAAAACCGTTGAAGCAGTC
GAAGAATCAATCGTCTCCATCACTCTTCCAGAGACAGCTGCATACGTAGAGCCAGAAGAAGTCTCA
ATCTGGGGAATCCCACTTCTAGAGGACGAAAGATCCGACGTGATCCTCCTCAAATTCCTCCGTGCA
CGTGACTTCAAGGTCAAAGAAGCCTTCACGATGCTGAAAAACACCGTCCAATGGCGCAAAGAGAAC
AAGATCGACGACCTAGTCTCAGAAGATCTTGAAGGAAGCGAGTTTGAGAAGTTGGTGTTCACTCAC
GGTGTCGACAAACAAGGACATGTCGTGATCTATAGCTCGTACGGTGAGTTTCAGAACAAGGAGATT
TTCTCAGATAAAGAGAAGCTTAGCAAGTTTCTCAAATGGAGGATTCAGTTCCAAGAGAAGTGTGTG
AGGTCTCTTGACTTTAGCCCTGAGGCTAAGTCATCGTTCGTGTTCGTTAGTGACTTCAGGAACGCT
CCTGGACTTGGTCAGAGAGCATTGTGGCAGTTCATTAAACGCGCCGTTAAGCAATTCGAAGATAAC
TATCCAGAGTTTGTCGCTAAAGAGCTGTTCATTAATGTCCCATGGTGGTACATTCCTTACTACAAA
ACATTCGGAAGTATCATTACATCGCCAAGGACAAGGAGCAAGATGGTCCTTTCTGGTCCATCCAAA
TCCGCTGAGACCATTTTCAAATACGTAGCTCCTGAAGTAGTCCCGGTTAAGTATGGTGGACTCAGC
AAAGATAGTCCATTCACCGTTGAAGATGGAGTCACCGAGGCCGTAGTTAAATCGACATCTAAATAT
ACCATTGATTTGCCTGCTACAGAGGGTTCCACGCTCTCATGGGAGCTTAGGGTTTTGGGTGCGGAC
GTGAGCTACGGAGCTCAATTTGAGCCAAGCAATGAGGCAAGCTACACCGTGATTGTCTCTAAGAAC
CGGAAGGTCGGTTTAACTGATGAACCGGTGATAACCGATTCTTTCAAGGCAAGTGAGGCGGGAAAG
GTCGTGATCACGATTGACAACCAAACCTTTAAGAAGAAGAAGGTGCTCTACAGGTCCAAAACCCAA
GCATAA

SEQ ID NO: 44, protein - Arabdidopsis thaliana
MAQEEIQKPTASVPVVKEETPAPVKEVEVPVTTEKAVAAPAPEATEEKVVSEVAVPETEVTAVKEE
EVATGKEILQSESFKEEGYLASELQEAEKNALAELKELVREALNKREFTAPPPPPAPVKEEKVEEK
KTEETEEKKEEVKTEEKSLEAETKEEEKSAAPATVETKKEEILAAPAPIVAETKKEETPVAPAPVE
TKPAAPVVAETKKEEILPAAPVTTETKVEEKVVPVETTPAAPVTTETKEEEKAAPVTTETKEEEKA
APGETKKEEKATSTQVKRASKFIKDIFVSVTTSEKKKEEEKPAVVTIEKAFAADQEEETKTVEAV
EESIVSITLPETAAYVEPEEVSIWGIPLLEDERSDVILLKFLRARDFKVKEAFTMLKNTVQWRKEN
KIDDLVSEDLEGSEFEKLVFTHGVDKQGHVVIYSSYGEFQNKEIFSDKEKLSKFLKWRIQFQEKCV
RSLDFSPEAKSSFVFVSDFRNAPGLGQRALWQFIKRAVKQFEDNYPEFVAKELFINVPWWYIPYYK
TFGSIITSPRTRSKMVLSGPSKSAETIFKYVAPEVVPVKYGGLSKDSPFTVEDGVTEAVVKSTSKY
TIDLPATEGSTLSWELRVLGADVSYGAQFEPSNEASYTVIVSKNRKVGLTDEPVITDSFKASEAGK
VVITIDNQTFKKKKVLYRSKTQA FIGURE 5 (continued)

SEQ ID NO: 45, DNA - Arabdidopsis thaliana
ATGGATGCTTCATTGTCTCCATTCGATCACCAAAAAACTCAAAACACAGAGCCAAAGAAAAGCTTC
ATTACCTCACTAATCACTCTCCGTTCAAACAACATCAAAGAAGACACATACTTCGTCTCAGAACTC
AAACCCACGGAGCAAAAATCACTTCAAGAACTCAAAGAAAAGCTCTCAGCTTCATCCTCCAAAGCT
TCTTCAATGTGGGGAGTCTCACTCCTCGGTGGAGACGACAAAGCTGACGTAATCCTCCTCAAGTTC
CTCAGAGCAAGAGATTTCAAAGTAGCAGACTCTTTGAGAATGCTTGAGAAGTGTTTGGAGTGGAGA
GAAGAGTTCAAAGCAGAGAAATTGACAGAAGAAGATCTGGGTTTTAAAGATTTGGAAGGTAAAGTT
GCTTACATGAGAGGCTACGACAAAGAAGGACACCCAGTTTGTTACAATGCTTATGGTGTGTTTAAA
GAGAAAGAGATGTATGAGAGTGTTTGGTGATGAAGAGAAGCTTAACAAGTTTCTGAGATGGAGA
GTTCAGGTTTTGGAGAGAGGTGTTAAAATGCTTCATTTTAAACCTGGTGGTGTTAATTCCATTATT
CAAGTTACAGATCTTAAAGATATGCCTAAGAGAGAGCTTAGAGTTGCTTCTAATCAGATCCTCTCT
CTTTTTCAAGATAATTACCCTGAATTGGTTGCTACTAAGATATTCATAAACGTGCCTTGGTACTTC
AGTGTGATCTACTCAATGTTCAGCCCATTCCTGACTCAGAGAACAAAGAGCAAGTTTGTGATGTCC
AAAGAAGGCAATGCAGCAGAAACACTCTACAAGTTCATTAGGCCAGAAGATATTCCGGTGCAATAC
GGTGGTCTTAGCCGTCCTACTGATTCGCAAAACGGACCGCCAAAACCGGCGTCTGAATTCTCCATC
AAGGGTGGTGAGAAAGTTAACATTCAGATTGAAGGCATTGAGGGTGGAGCAACCATAACATGGAT
ATAGTAGTTGGAGGATGGGATTTAGAGTACAGTGCAGAGTTTGTTCCAAACGCTGAAGAGAGTTAC
GCGATCGTTGTCGAGAAACCGAAGAAGATGAAAGCTACAGATGAAGCTGTTTGCAACTCTTTCACT
ACAGTAGAAGCTGGGAAGCTCATTCTCTCTGTTGACAATACTCTCTCTCGCAAGAAGAAAGTTGCT
GCTTACCGTTACACTGTCCGGAAATCTACTACAACCGTCTAA

SEQ ID NO: 46, protein - Arabdidopsis thaliana
MDASLSPFDHQKTQNTEPKKSFITSLITLRSNNIKEDTYFVSELKPTEQKSLQELKEKLSASSSKA
SSMWGVSLLGGDDKADVILLKFLRARDFKVADSLRMLEKCLEWREEFKAEKLTEEDLGFKDLEGKV
AYMRGYDKEGHPVCYNAYGVFKEKEMYERVFGDEEKLNKFLRWRVQVLERGVKMLHFKPGGVNSII
QVTDLKDMPKRELRVASNQILSLFQDNYPELVATKIFINVPWYFSVIYSMFSPFLTQRTKSKFVMS
KEGNAAETLYKFIRPEDIPVQYGGLSRPTDSQNGPPKPASEFSIKGGEKVNIQIEGIEGGATITWD
IVVGGWDLEYSAEFVPNAEESYAIVVEKPKKMKATDEAVCNSFTTVEAGKLILSVDNTLSRKKKVA
AYRYTVRKSTTTV

SEQ ID NO: 47, DNA - Arabdidopsis thaliana
ATGACTGCTGAAGTTAAGGTTGAGGAGAAACAGGTGGAGTCAGAGGTTGTTATTGCTCCTGCTGTT
GTTCCTGAGGAGACTACTGTTAAGGCTGTTGTGGAAGAGACTAAGGTTGAAGAAGATGAGAGCAAG
CCTGAGGGTGTGGAGAAGAGTGCTTCCTTCAAGAAGAGAGTGATTTCTTTGCTGATTTGAAAGAA
TCTGAGAAAAAGGCACTGAGTGATCTCAAGTCTAAGCTTGAGGAAGCTATTGTTGACAACACTCTC
TTAAAGACGAAGAAGAAGGAGAGCTCTCCTATGAAGGAGAAGAAGGAAGAGGTTGTGAAACCTGAA
GCTGAGGTTGAGAAGAAGAAGGAAGAAGCAGCAGAGGAGAAGGTTGAAGAAGAGAAGAAATCTGAG
GCTGTTGTTACCGAAGAAGCACCGAAAGCTGAGACTGTTGAGGCTGTTGTTACAGAGGAGATAATC
CCCAAGGAAGAAGTGACTACTGTTGTTGAGAAGGTAGAAGAAGAAACCAAGGAAGAAGAGAAGAAA
ACCGAGGATGTTGTTACTGAAGAAGTGAAAGCTGAGACTATTGAGGTGGAGGATGAAGATGAGTCG
GTGGATAAGGATATCGAGCTTTGGGGAGTGCCATTGCTTCCAAGCAAAGGAGCTGAAAGCACGGAT
GTTATCCTCTTGAAGTTCTTGAGAGCAAGAGACTTTAAAGTCAACGAAGCCTTTGAGATGCTGAAG
AAAACCCTCAAATGGAGAAAGCAAAACAAGATTGATTCGATCCTTGGAGAGGAGTTTGGGGAGGAT
CTTGCCACTGCAGCTTACATGAACGGTGTGGACCGCGAGTCCCACCCAGTTTGTTACAATGTCCAC
AGCGAGGAGCTTTACCAGACGATTGGGTCGGAGAAGAACAGAGAGAAGTTCTTGAGATGGAGGTTT
CAGCTGATGGAGAAGGGAATCCAGAAGCTTAATCTTAAACCAGGAGGTGTTACTTCTCTTCTCCAG
ATCCACGATCTCAAAAACGCTCCTGGAGTGTCAAGAACAGAGATTTGGGTCGGAATCAAGAAAGTA
ATCGAGACTTTGCAGGACAACTATCCGGAATTCGTGTCCAGAAACATATTCATCAACGTTCCATTC FIGURE 5 (continued)

```
TGGTTCTACGCCATGAGAGCTGTCCTCTCGCCATTCTTAACTCAACGAACCAAGAGCAAGTTTGTT
GTGGCTCGTCCCGCTAAGGTCAGAGAGACTCTTCTCAAGTACATTCCAGCTGATGAGCTCCCAGTT
CAGTACGGTGGGTTCAAAACAGTAGACGATACCGAATTCTCCAACGAAACTGTCTCTGAAGTTGTT
GTTAAGCCTGGATCATCTGAAACCATCGAAATCCCAGCTCCTGAGACTGAAGGTACATTGGTATGG
GACATAGCGGTTTTGGGATGGAAGTGAATTACAAGGAAGAGTTTGTGCCAACAGAAGAAGGAGCT
TACACGGTAATAGTCCAAAAGGTGAAGAAGATGGGAGCAAATGAAGGACCAATCAGGAACAGTTTC
AAGAACAGTCAGGCTGGTAAGATTGTTCTTACCGTTGACAATGTCTCTGGCAAGAAGAAGAAAGTT
CTGTACAGGTACAGAACCAAGACTGAATCCTCTTCCTGA
```

SEQ ID NO: 48, protein - Arabdidopsis thaliana
```
MTAEVKVEEKQVESEVVIAPAVVPEETTVKAVVEETKVEEDESKPEGVEKSASFKEESDFFADLKE
SEKKALSDLKSKLEEAIVDNTLLKTKKKESSPMKEKKEEVVKPEAEVEKKKEEAAEEKVEEEKKSE
AVVTEEAPKAETVEAVVTEEIIPKEEVTTVVEKVEEETKEEEKKTEDVVTEEVKAETIEVEDEDES
VDKDIELWGVPLLPSKGAESTDVILLKFLRARDFKVNEAFEMLKKTLKWRKQNKIDSILGEEFGED
LATAAYMNGVDRESHPVCYNVHSEELYQTIGSEKNREKFLRWRFQLMEKGIQKLNLKPGGVTSLLQ
IHDLKNAPGVSRTEIWVGIKKVIETLQDNYPEFVSRNIFINVPFWFYAMRAVLSPFLTQRTKSKFV
VARPAKVRETLLKYIPADELPVQYGGFKTVDDTEFSNETVSEVVVKPGSSETIEIPAPETEGTLVW
DIAVLGWEVNYKEEFVPTEEGAYTVIVQKVKKMGANEGPIRNSFKNSQAGKIVLTVDNVSGKKKKV
LYRYRTKTESSS
```

SEQ ID NO: 49, DNA - Arabidopsis thaliana
```
ATGTCTCAAGATTCTGCAACTACTACTCCGCCGCCACCTTTAACCTCCGACGTTTCAATGCCTTCC
GGTGAAGAAGATGAGCCAAAGCATGTAACATCGGAAGAAGAGGCACCGGTGACTTCGGAGACAAAT
CTGAAGCTACCTTTGATGCCGGAGCTAGAGGAGTCAAATCATACGGCGGAGGTTGTTTCAGAGAAG
GTGACGCCGGAGACGATGACTTTGGAGTCAGAAGGTCTCAACCACGCGGCGGAGGATTCAGAGCAG
ACACATGAAGTGACGCCGGAGACAGAGACTGCGAAGCTAGAGGTTCTCAACCACACGGCGGAGGAT
TCAGAGCAGACACATGAAGTGACGCCGGAGAAAGAGACTGTGAAATCAGAGTTTCTCAACCACGTG
GCGGAGGATTCAGAGCAGACACATGAAGTGACGCCGGAGACAGAGACTGTGAAGTCAGAGGTTCTC
AACCATGCGGCGGAGGATTCAGAGCAGCCACGTGGAGTGACACCGACGCCGGAGACAGAAACATCG
GAGGCAGACACGTCATTGCTTGTAACTTCCGAGACAGAAGAGCCTAACCATGCGGCGGAGGATTAT
TCAGAGACAGAGCCATCACAGAAACTAATGTTGGAGCAGAGGAGAAAGTACATGGAAGTAGAAGAT
TGGACAGAGCCAGAACTACCAGATGAAGCGGTGTTAGAAGCTGCAGCGTCAGTCCCTGAGCCAAAG
CAACCAGAGCCTCAGACACCACCACCACCACCATCTACTACTACTTCCACTGTTGCATCTAGATCT
TTAGCCGAAATGATGAACAGAGAAGAAGCAGAAGTAGAAGAGAAACAAAAGATTCAGATTCCTCGT
AGTCTCGGTTCATTCAAAGAAGAAACAAACAAAATCTCCGATCTTTCAGAAACAGAGTTAAACGCA
CTTCAAGAGCTTCGTCACCTTCTTCAAGTATCACAAGATTCAAGCAAAACCTCTATATGGGGTGTG
CCACTTCTCAAAGACGACAGAACCGACGTCGTTTTGTTAAAGTTTCTAAGAGCAAGAGACTTTAAA
CCTCAAGAAGCTTACTCAATGCTAAACAAGACACTCCAATGGAGAATCGACTTCAACATCGAAGAG
CTTCTAGACGAAAACCTCGGTGACGATTTAGACAAAGTTGTGTTCATGCAAGGACAAGACAAGGAG
AATCATCCTGTCTGTTACAATGTCTACGGTGAGTTTCAGAACAAAGATCTTTATCAGAAAACGTTT
TCAGATGAAGAGAAGAGAGAACGGTTCTTGAGATGGAGGATTCAGTTTCTTGAAAAGAGTATCAGG
AATCTTGATTTTGTAGCTGGTGGTGTTTCCACGATATGTCAAGTAAATGATCTTAAGAATTCTCCA
GGACCTGGTAAGACTGAGCTTAGGTTAGCTACTAAGCAAGCTCTTCATCTTCTTCAAGACAATTAC
CCTGAGTTTGTCTCTAAACAGATATTCATCAATGTTCCATGGTGGTACCTTGCGTTCTATAGAATT
ATTAGTCCTTTTATGTCACAAAGGTCAAAGAGCAAACTAGTTTTCGCAGGTCCTTCAAGATCTGCA
GAAACCCTTCTCAAGTACATATCACCCGAACATGTCCCGGTTCAGTATGGTGGACTAAGTGTGGAT
AATTGCGAGTGTAACTCGGATTTCACACACGATGATATCGCTACCGAGATTACTGTTAAACCAACT
ACTAAACAAACCGTCGAGATTATTGTTTACGAGAAATGTACAATCGTGTGGGAGATAAGAGTAGTG
```

GGATGGGAGGTTTCGTATGGAGCGGAGTTTGTGCCGGAGAACAAAGAAGGGTATACAGTGATCATT
CAGAAACCGAGGAAGATGACTGCGAAAAATGAACTGGTGGTGTCTCATAGCTTCAAAGTTGGAGAA
GTTGGCAGGATTTTGCTAACTGTTGATAACCCGACTTCGACCAAGAAAATGCTTATCTACAGGTTC
AAGGTTAAGCCTTTAGCTTGTGAGTAA

SEQ ID NO: 50, protein - Arabdidopsis thaliana
MSQDSATTTPPPPLTSDVSMPSGEEDEPKHVTSEEEAPVTSETNLKLPLMPELEESNHTAEVVSEK
VTPETMTLESEGLNHAAEDSEQTHEVTPETETAKLEVLNHTAEDSEQTHEVTPEKETVKSEFLNHV
AEDSEQTHEVTPETETVKSEVLNHAAEDSEQPRGVTPTPETETSEADTSLLVTSETEEPNHAAEDY
SETEPSQKLMLEQRRKYMEVEDWTEPELPDEAVLEAAASVPEPKQPEPQTPPPPSTTTSTVASRS
LAEMMNREEAEVEEKQKIQIPRSLGSFKEETNKISDLSETELNALQELRHLLQVSQDSSKTSIWGV
PLLKDDRTDVVLLKFLRARDFKPQEAYSMLNKTLQWRIDFNIEELLDENLGDDLDKVVFMQGQDKE
NHPVCYNVYGEFQNKDLYQKTFSDEEKRERFLRWRIQFLEKSIRNLDFVAGGVSTICQVNDLKNSP
GPGKTELRLATKQALHLLQDNYPEFVSKQIFINVPWWYLAFYRIISPFMSQRSKSKLVFAGPSRSA
ETLLKYISPEHVPVQYGGLSVDNCECNSDFTHDDIATEITVKPTTKQTVEIIVYEKCTIVWEIRVV
GWEVSYGAEFVPENKEGYTVIIQKPRKMTAKNELVVSHSFKVGEVGRILLTVDNPTSTKKMLIYRF
KVKPLACE

SEQ ID NO: 51, DNA - Populus trichocarpa
GACTCAGTACTAACATCTGAATCTGATGTTAGTACTGAGATTAAACCACCAGCAGAGACTCAGGAA
TCAAAAGTTGAAGAAACCCCAGAAAAAGAATCACAAGAAGTGGCAAAAGAAGAGCAAAAGGCTGCA
CCTTCACCAGAGGAGATCACTATATGGGGGATCCCTCTTCTGAAAGATGATAGAAGTGATGTGGTT
CTCTTGAAGTTCTTGAGGGCAAGGGATTTTAAGGTAAGCGATGCATTTGTAATGATCAAGAACACA
ATTCAATGGAGGAGAGACTTTAAAATTGATGAGCTTGTTGATGAAGATCTAGGTGATGATTTGGAG
AAAGTTGTGTTTATGCATGGTTATGACAGGGAAGGGCATCCTGTGTGTTATAATGTGTATGGGGAG
TTTCAAAATAAAGAGTTGTATCAGAAGACATTCTCTGATGAGGAGAAAAGATTGAAGTTTTTGAGG
TGGCGGATTCAGTTCTTGGAGAGGAGTATTAGGAAGCTTGATTTTAGTCCTAGTGGTATTTCCACC
GTCTTCCAGGTTAATGATCTCAAGAACTCTCCAGGACCCGGAAAGAGAGAGCTTAGGTTGGCTACT
AAACAGGCTCTCCTATTGCTTCAGGACAATTACCCTGAGTTTGTGGCCAAACAGGTGTTCATCAAT
GTCCCTTGGTGGTATCTTGCATTTTATACAATGATCAGTCCATTTATGACACAAAGAACCAAAAGC
AAATTTGTATTCGCAGGCCCATCAAAATCTGCTGAGACACTTTTCAAATATGTATCTCCTGAGCAA
GTTCCTATTCAGTATGGTGGCTTGAGCGTGGATTTCTGCGACTGCAACCCCGAATTTACTTTTGCT
GATCCTGCTACTGAGATAACTGTAAAACCAGCAACCAAGCAAACTGTGGAATTATAATTTATGAG
AAATGTTTCATTGTTTGGGAGTTGCGAGTTGTTGGATGGGAGGTGAGTTATAGTGCTGAATTCGTG
CCCGATTCTAAAGATGCATACACAATTATAATGACAAAACCCACAAAAATGACCCCAACCAATGAG
CCAGTGGTGTCTAACAGCTTCAAAGTTGGTGAGCTGGGAAAAATATTGCTCACAGTTGACAACTCT
ACCTCAAAGAAGAAGAAACTTCTCTACAGGTTCAAGATAAACCCCTTCTCAGATTGAGGAACTCTT
TGTATTTAATGTTTCCATCTCAGATAGTTGTGGAAATTGAATTAATTTTATGTACTCTGGGTGAGC
CTTTTGTCTCTCGTCTTTTTCTCTACCGAATAGCACATGGTTTGCATTCGGTGTTTTTTTGCCA
ATCATCTTGGGGAAAACAAACAGATGTGTGGGCATATGGAGGGGGGTGTGGTTGTGAAACTTATAT
ATACATAAATGTGCCATTTCATTGAGGCGTTTTGCGATGCGCTTTCTCGTTTATCTGGATGTCAAT
ATTTCAGTACCATTTACCTTTATGTAATCTCAAAACTCTTATGTTATTGCGACATCGAATACTTCA
ATTTGACATCATCTTTAAAGTTGA

SEQ ID NO: 52, protein - Populus trichocarpa
MIKNTIQWRRDFKIDELVDEDLGDDLEKVVFMHGYDREGHPVCYNVYGEFQNKELYQKTFSDEEKR
LKFLRWRIQFLERSIRKLDFSPSGISTVFQVNDLKNSPGPGKRELRLATKQALLLLQDNYPEFVAK
QVFINVPWWYLAFYTMISPFMTQRTKSKFVFAGPSKSAETLFKYVSPEQVPIQYGGLSVDFCDCNP
EFTFADPATEITVKPATKQTVEIIIYEKCFIVWELRVVGWEVSYSAEFVPDSKDAYTIIMTKPTKM
TPTNEPVVSNSFKVGELGKILLTVDNSTSKKKKLLYRFKINPFSD

FIGURE 5 (continued)

SEQ ID NO: 53, DNA - Populus trichocarpa
GGGAGGATTCAATTCCTGGAAAAAAGTATCAGGACATTGGATTTCAGTCCCGGTGGAATTTCCACA
ATTGTTCAGGTTAATGACTTGAAAAATTCTCCTGGACCAGCTAAGAGAGAGCTTAGACAAGCTACT
AGACAGGCACTTCAATTGCTTCAAGACAACTATCCAGAATTTGTGGCCAAACAGATCTTCATCAAT
GTTCCCTGGTGGTACCTAACAGTAAATAGAATGATAAGTCCATTTTTAACCCAGAGGACCAGAAGC
AAGTTTGTCTTTGTTGGTCCTTCCAAATCTGCCGAAACCCTTATCAGGTACATAGCCGCTGAGCAA
ATACCAGTGAAGTACGGAGGACTAAGCAAAGATGGTGAATTTGGCTCAGCTGATGTTGTTACTGAG
ATTACCGTGAAGCCAGCAGCAAAGCACACTGTAGAATTCCCAGTTACTGAGACATGCCTTTTAACA
TGGGAAGTGAGAGTTGCGGATGGGATGTGAGCTATAGTGCAGAATTTGTACCAAGTGCTGAAGAT
AGCTACACAGTGATCATCCAAAAGGCTAGAAAGGTTGCTGCAACTGAAGAACCAGTGGTTTGCAAC
AGTTTCAAAATTGGTGAACCTGGTAAAGTTGTTCTCACCATTGACAACTCCACATCCAAGAAGAAG
AAGAAGCTCCTCTATCGCTTGAAAACCAAGCCCGCTTCTTCTGATTAATTAAGGGACTATATATAT
TGAAACAACAATAGAAGATTTTGCTTACATTCTTGCTGCTGCTGCTGCTGCCAATTTATCAACAT
GATCATATCACAGCTTGAAGGTGTTCTGAGGGTCTTGATCATGGAGAAGATAAAGAAATCTTGAAG
ATGTTTATTTATATGTTTATTTATAATTGAATTTTGTTTTGGTGTGGAATGGATTAAGGATGTTGT
GCAATTGAAGGCTAGAAGCATGTATGGGGATAGGGAAGAAGCTCCATTACTAGTGCCAAGAATTTT
CTTTGTAAATTCTTTATGGCTTTCTTTCTCTTTCCCTGTAAGTATCTTTTGGACATATTATGATAT
TAATGAAGACAGTATCTTTCCTAT

SEQ ID NO: 54, protein - Populus trichocarpa
MISPFLTQRTRSKFVFVGPSKSAETLIRYIAAEQIPVKYGGLSKDGEFGSADVVTEITVKPAAKHT
VEFPVTETCLLTWEVRVAGWDVSYSAEFVPSAEDSYTVIIQKARKVAATEEPVVCNSFKIGEPGKV
VLTIDNSTSKKKKKLLYRLKTKPASSD

SEQ ID NO: 55, DNA - Populus trichocarpa
ATGTGTTCATCAATGTTCCATGGTGGTACCTAACATTCAATAAGATGATCAGCCCTTTCCTGACAC
ACAGGACAAAGAGCAAGTTTGTTTTTGCTGGCCCATCCAAGTCTGCTGAAACACTTTTCAAATACA
TAGCTCCTGAAGAAGTGCCAGTTCAATATGGTGGACTAAGCAAGGATGGCGAATTCACAGGTGCCG
ATACCGTCACAGATGTTACTATTAAGCCAACATCAAAGCACACTGTTGAGTTCCCAGTGTCTGAGG
CATGTGTTCTCGTTTGGGAGCTTCGAGTTTTTGGTTGGATGTGAGCTATGGAGCTGAATTCGTGC
CTAGCGCTGAGGATGGTTACACCGTTATCGTATCAAAGACCAGGAAGATTATCTCATCCGATGATC
CTGTGATCTCAGACACATTCAAAATTGGTGAACCTGGCAAGGTTGTGCTTACCATTGATAACCAAA
CCTCTAAGAAGAAGAAGCTCCTCTATAGGTCAAAGACCAAACCCCTTTCTGAATGAGCTTCAAGAA
TCAATGCCTTCGTGGGGTTTTGAACTTCCATTAATTTAGAAGACATGGATGGCATAACAAGGGGTC
CTTGGTCATGATGCATGAACACGAGGTGTGGAGTTTTGTTCTGTTTAAATTTAATATATTTTTTGT
TTTATAAAGTCTGGGTTTGGGCTGGGATTTGTTGTTTGGTGTTTAATTGGATACAATGTACTGGTG
AAGACAGTCTGGGATTATCATGGATTGACAGACACATTTGAGGTTTAAGTGTGAAGAATATGAAAA
TGTGTTTGCCAAAGTTGAAAGACTATCCTTTTTTGTTCTTGGTACTCTTACCTGTAAAATTTGTGT
AAATGTGATGGTGTTCTACTTCTTCCTTCTTAATTAATACATGTATTTTTTAC

SEQ ID NO: 56, protein - Populus trichocarpa
MISPFLTHRTKSKFVFAGPSKSAETLFKYIAPEEVPVQYGGLSKDGEFTGADTVTDVTIKPTSKHT
VEFPVSEACVLVWELRVFGWDVSYGAEFVPSAEDGYTVIVSKTRKIISSDDPVISDTFKIGEPGKV
VLTIDNQTSKKKKKLLYRSKTKPLSE

FIGURE 5 (continued)

SEQ ID NO: 57, DNA - Populus trichocarpa
ACTAGTTTAATTAAATTAATCCCCCCCCCCGTGGTATTGCTTCTTTGCTTCAAATCAGTGATCTCA
AGAATTCTCCTTCCCCATCAAAGAAAGAGCTCAGGACTGCCATGAGCAAAGCTGTCACCCTTTTGC
AGGACAATTATCCAGAATTTGTTGCAAAAAATATATTCATAAATGTTCCATTTTGGTATTATGCTT
TCAACGCCCTGCTATCTCCTTTCTTGGCTCAAAGAACCAAGAGCAAATTTGTCGTTGTTCGCCCTG
CCAAGACCACCGAGACATTGCTCAAGTATGTTCAGGCCGAGGAAATCCCTGTCCAATATGGTGGCT
TCAAGAGGGAGAATGATTTCGAGTTCTCCAGCGAAGATGGTGAAGTTTCAGAACTTGTAATCAAAG
CTGGATCAACTGAAACCATTGAGATCCCTGCAGCAGAGGTTGGAGCCACATTGCTTTGGGACCTGA
CAGTTGTGGGATGGGAAGTGAATTACAAGGAGGAATTTGTGCCAAGTGATGAAGCTTCCTACACCA
TCATCATCCAAAAGGGCAAGAAAATGAGCTCAAATGAAGAGCCAACTCGCAACACTTTCAGGAACA
ATGAACCTGGAAAGGTAGTTCTGACCATTCAGAATTGGTCAAGCAAGAAGAAGAGGGTCCTATACC
GATACAAGACCAAGAAGAATGCTTCCTATTGAGACAAGACTCCATTCTTTTATATTATCAGTCTTT
TATTTGCCGTGACAATTCTTTTCTAGATAGAAAACATTGATTCTTTTCAGGATTGATATCTATATC
TATATCTGATCGTGTGATTTGATTTGTTATTTCTGGGGTTCCTTTTTC

SEQ ID NO: 58, protein - Populus trichocarpa
MSKAVTLLQDNYPEFVAKNIFINVPFWYYAFNALLSPFLAQRTKSKFVVVRPAKTTETLLKYVQAE
EIPVQYGGFKRENDFEFSSEDGEVSELVIKAGSTETIEIPAAEVGATLLWDLTVVGWEVNYKEEFV
PSDEASYTIIIQKGKKMSSNEEPTRNTFRNNEPGKVVLTIQNWSSKKKRVLYRYKTKKNASY

SEQ ID NO: 59, DNA - Lycopersicum esculentum
GGAGAAAGTAACTCCACCGGAAACTGAAGCAACTCCGGCGCCGGCAGCAGAGACACCATCTGAGCC
ATCGGAGACAGAGAAGGTGGAGGCAGTCGAGGAAATCAAGGAAACCATTGTTGAAGTACCGGCTGC
GGTTGCTGTGATGGCCTCCACGGAGGAGCCACCGGCTGCAGAGGCAGAGGAACCGAAAACAGAGCA
AACCCCACCAGCAGCACCAGAAGAAGTATCCATATGGGGAATACCCCTTTTAGCAGATGAGAGAAG
TGATGTAATCCTTCTCAAGTTTCTGCGAGCGAGAGATTTCAAGGTGAAAGAAGCTTTCACCATGTT
GAAAAGTGTTGTCGCATGGAGAAAAGAATTCAAGATTGATGAACTCTTGGATGAGAAAGAATTAGG
ACAAGGACTTGAAAAAGTTGTTTACAATCACGGAGTAGACAAAGAAGGTCACCCTGTATGTTACAA
TGCATTTGGTGAGTTCCAAGACAAAGAATTGTACCAAAACACTTTTGCTGATGACAAAGAGAAACT
CACCAAATTCCTCAGATGGAGAATTCAATTCATGGAGAAATCCATCAGGAATCTTGATTTTAGCCC
TGATGGTATCAACACTTTTGTTCAAGTTCTTGATCTGAAGAATTCACCTGGACTCTTCTTTTACAA
GAAAGAACTTCGCCAAGCCACCAATCGTGCCCTTCTATTACTCCAGGATAATTACCCTGAATTTGT
TGCCAAGCAGGTGTTCATCAATGTTCCATGGTGGTACCCAGCTTACTACAGGATGATTAATGCATC
TTTCACTACAAGGACCAAGAGCAAGTTTGTTTTGCTGGTCCTTCAAGATCTGCTGATACTCTATT
CAAATACATAGCACCTGAACAAGTACCAGCACAATATGGTGGACTTAGCAAGGAGGGTGAAGAGGA
ATTCACCACTGCTGAACCAGCCACTGAGGAAATCATTAAGCCAGCTTCTAAACACACCATTGAATT
CCCAGTTACTGAGAAAAGCACATTGGTTTGGAAGCAAGAGTGACAGGGTGGGATGTATCATATGG
AGCTGAATTTGTGCCTAGTGCTGAAGGTGGCTACACCATTCTCATAGAGAAATCAAGAAAAGTTGG
GGCAAATGAATCAGTGATCAGCACTAGCTACAAGGCAAGTGAAGCAGGCAAAGTGGTAATCACAAT
TGACAACCAAACTTCTAAAAAGAAGAAACTTGTTTACAGGTCCAAGAACAAGATCTCAGATTGCTG
AGCCGCCTTTTCTTGTTTCATAGATTTTTCTTTTGGTTGATATCAACTAGTACTATTATTTTGAGC
TTTTTGGGGGTATTTATTTATATTTTATTGGGGTTATTTTTTGAGCTATTTTGCTGTTGGATTGTT
TTTTTTATTATATGGGGAATATTTATTATATTACAAAGGGGTTGAGATGTGGAGTACAAGTTATTG
ATACATTTTCTTCTGAAATATTTTGTGTAAATCTAATGCTGCCTCTCATTTTCCTTACATTTTTTT
GGTGATGTGAAGCTTAACGTTAGTTAATCCTATACTTATGTTTCCT

FIGURE 5 (continued)

SEQ ID NO: 60, protein - Lycopersicum esculentum
MASTEEPPAAEAEEPKTEQTPPAAPEEVSIWGIPLLADERSDVILLKFLRARDFKVKEAFTMLKSV
VAWRKEFKIDELLDEKELGQGLEKVVYNHGVDKEGHPVCYNAFGEFQDKELYQNTFADDKEKLTKF
LRWRIQFMEKSIRNLDFSPDGINTFVQVLDLKNSPGLFFYKKELRQATNRALLLLQDNYPEFVAKQ
VFINVPWWYPAYYRMINASFTTRTKSKFVFAGPSRSADTLFKYIAPEQVPAQYGGLSKEGEEEFTT
AEPATEEIIKPASKHTIEFPVTEKSTLVWEARVTGWDVSYGAEFVPSAEGGYTILIEKSRKVGANE
SVISTSYKASEAGKVVITIDNQTSKKKKLVYRSKNKISDC

SEQ ID NO: 61, DNA - Medicago truncatula
TTATACATAAAACACATCAACCCAAGCCCAATTGTCTCCAACTCCAACTCCAAACCCATCATCTCA
CTCTCTCTATATTAGTCTTTTCTCAATACCCAAATATCACTTTTTCTTAACCTTAACCTTAACCCT
AATATCATCTCACTCTTTTTTCATATCAAATGGCTGCTGAACCTCAAAAACCTGCTGAAGAAGTTG
CCACAACCACCTCTGAAACTGTTGTTGAGAAGAACAACAGGCTGATGGAGTTGTAGCTGCTGCTG
TTACCGCTGCCGCTGTTACCGCTGCCACCACTGATAAGGAAGCTGTTGCTGATCCTCCTCCTGCTG
TTGCTGATGAGGCTGAGAAGCCGGCGGAAGTTGTGGCTGATAAGGTGGCGGATGAAACTGTTGTTG
ATGAAAGCAAGGTTTCTCAATCGGTTTCTTTTAAGGAAGAAACTAACGTGGTTTCTGAACTTCCTG
ACGTTCAGAAAAAGCACTTGATGAACTTAAACAACTTATTCAAGAAGCGCTTAACAAACATGAAT
TCACCGCTCCTCCACCCGCTCCAGTCAAAGCACCTGAACCTGAAGTAGCTGTAAAAGAAGAGAAAA
AGCCTGAAGAAGATGAAAAGAAACCGAAGAGGTGGTAGAAGAGAAGAAAGATGAAGCAGTAGTTG
AGGAGAAGAAGGTTGATGAAGAAAAAGGTTCAACCTCTGAGGAACCTAAAGTTGAAACTGCTGAAC
CTGAAAAGGAGGAGAAGAAAGTGGAGGAAACGGTTGTAGAAGTTGTTGAGAAAATAGCTGCAAGTA
CCGAAGAAGACGGTGCGAAAACAGTTGAGGCTATTCAGGAAAGTATAGTATCTGTTCCAGTTACTG
AAGGTGAACAACCTGTTGCTGAGCCTGTTGCTGAAGTGGAGGTTACTCCTATTGTACCAGAAGAAG
TTGAAATATGGGGAATTCCATTACTAGCTGATGAAAGAAGTGATGTGATTCTTCTCAAGTTCTTGA
GAGCTAGGGATTTTAAGGTGAAGGAGGCTTTCACTATGATCAAACAAACCGTGCTTTGGCGAAAGG
AATTCGGAGTCGAAGCACTTCTTCAAGAAGATCTTGGAACTGACTGGGACAAAGTTGTTTTCACTG
ATGGTACTGACAAAGAAGGTCACCCTGTTTATTACAATGTTTTTGGTGAGTTTGAGGATAAGGATT
TGTATCAAAAACATTCTCTGATGAAGAGAAGAGAACCAAGTTCGTTCGTTGGTGGATTCAGTCTT
TGGAGAAAAGTGTTAGGAAACTCGACTTTGCTCCATCTGGTATCTCTACTCTTGTTCAGATTAATG
ATCTTAAAAATTCTCCTGGACTTCTTGGTAAGAAAGAGCTTAGACAATCTATTAAGCAGACTCTTC
AGTTGCTTCAGGATAACTATCCTGAATTTGTTGCCAAACAGATTTTCATCAATGTTCCTTGGTGGT
ACCTTGCCTTCTCTAGGATGATCAGTCCTTTCCTGACACAAAGGACTAAGAGCAAATTTGTATTTG
CTGGTTCCTCCAAATCTGCTGAAACCCTTTTCAAATATATAGCTCCTGAGCAAGTGCCAGTTAAAT
ATGGAGGACTGAGCAGAGACGGTGAACAGGAATTCACCACTGCTGACCCTGCTACAGAGGTTACTA
TCAAACCAGCAACTAAACATGCTGTTGAGTTCCCAGTTTCTGAGAAAAGCACTTTGGTTTGGGAAG
TAAGAGTTGTGGATTGGAATGTGAGCTATGGAGCAGAATTTGTGCCTAGTGCTGAAGATGGATACA
CTGTGATAATCCAGAAGAACAGGAAAATTGCTGCAGCTGATGAAACAGTAATTAGCAACACCTTCA
AAGTTGGTGAACCTGGAAAAGTTGTACTCACCATTGATAACCAAACATCCAAGAAAAAGAAGCTGC
TTTACAGGTCCAAGACCATACCCATCTCTGAGTAAAAGGAAAAATGTTTAAATTCATTATATGGTC
AATAACATTATTGTGAAGGTTATTGGGTGGGTTACTTATATTCTTTTATAGGAATATTTCTTCAT
TTGGTTTGTAAATTATTTTGTTTCAAGTATGGGGTTGGGAAATTTTATTTACAGTTATTATCACTT
ATCAATATTCTTAAATTAATGTGGTATTTTGTTCTTTTGTGTTGGAATTGGATGAAACCTTTGCTG
GATGAAGAACACAATTGGGTTCTTTTGTAAAACAAAAGTTTATTGTTTTTGTTATCTTGTGACTCT
GTGATTGAAGGATTTATTTGAGTAATTTTTTATTCCAATTAGTCTAGTGGCC

FIGURE 5 (continued)

SEQ ID NO: 62, protein - Medicago truncatula
MAAEPQKPAEEVATTTSETVVEKEQQADGVVAAAVTAAAVTAATTDKEAVADPPPAVADEAEKPAE
VVADKVADETVVDESKVSQSVSFKEETNVVSELPDVQKKALDELKQLIQEALNKHEFTAPPPAPVK
APEPEVAVKEEKKPEEDEKKTEEVVEEKKDEAVVEEKKVDEEKGSTSEEPKVETAEPEKEEKKVEE
TVVEVVEKIAASTEEDGAKTVEAIQESIVSVPVTEGEQPVAEPVAEVEVTPIVPEEVEIWGIPLLA
DERSDVILLKFLRARDFKVKEAFTMIKQTVLWRKEFGVEALLQEDLGTDWDKVVFTDGTDKEGHPV
YYNVFGEFEDKDLYQKTFSDEEKRTKFVRWWIQSLEKSVRKLDFAPSGISTLVQINDLKNSPGLLG
KKELRQSIKQTLQLLQDNYPEFVAKQIFINVPWWYLAFSRMISPFLTQRTKSKFVFAGSSKSAETL
FKYIAPEQVPVKYGGLSRDGEQEFTTADPATEVTIKPATKHAVEFPVSEKSTLVWEVRVVDWNVSY
GAEFVPSAEDGYTVIIQKNRKIAAADETVISNTFKVGEPGKVVLTIDNQTSKKKKLLYRSKTIPIS
E

SEQ ID NO: 63, DNA - Beta vulgaris
TNNCCCGGGCTGCAGGAATTCGGCACGAGCTCATTTCTCTACATCAAAAACACAACAAAGAGATCA
CCCATGGCGGAAGAAACCCATAAGCCAGAATCAACGGTGGCTGAAGTGGTGGTTCCAGTAGCCGAG
AAACCAGCTGAGAAGCCAGCTGAGAAGGCAGTTCTACCACCTGAAGCTGAGAAACTAGCTGCAGCT
GAATCAGCTGAAGCCGAGAAGCCAGCTGATTCAGCCGAGGCTAAGATAGCTCAACAAGTCTCATTC
AAAGAGGAGACTAATGTTGCAAGTGAGCTACCTGAGCTACATAGAAAGGCTCTCGAGGACTTGAAG
AAACTTATTCAAGAAGCCCTCGAGAAGCACGAGTTCTCTTCTCCTCCTCCTCCGCCTCCGCCTGCT
CCAGCTAAAGTTGAGGAGAAGGCGGAAGAGAAGAAAGAGGAACAACCTCCATCCACCACCTCCACC
ACCACCACCACCACCGCGGTTTCAGATGAGGTTGCTGTTGCTCCTCCATCCGAAGAGGCCCCG
AAAACTGACGAGGCCTCTCCGAAAGTGGAGGAGGAGCCTGCAAAAATAGTTGAGCAACCACCTACA
ACACCGGCAGAAGAACCTGAACCAGCAAAAACACCTGAGGTTGTTGTTGCTGAAGAGGAGAAAACT
GGTGAGGATATTAAAGAAACTATAGTAGTCGAGGTTGCGACAACTACAGCAGCACCAGTACTAACA
GAACCAGAATCTGTTGAGGAGACACCAAAAGAAGCTGAAGTTGTAGTGGAAGAATCACCAAAGGAG
CCAGAAGAAGTATCAATATGGGGAATTCCACTTCTTGCTGATGAAAGAAGTGATGTAATTCTATTG
AAATTCTTAAGAGCAAGAGATTATAGAGTGAAAGATGCTTTCACTATGATTAGAAATACTGCTCGT
TGGAGAAAAGAATTTGAGGTTGATTCTTTACTTGATGAAGATCTTGGAAATGATTATGAGAAAGTT
GTTTTTACACATGGAGTTGATAAACAAGGTCGTCCTGTTTGTTATAATGTGTTTGGAGAGTTTCAA
AATAAGGAACTTTATCAGAATACTTTCTCTGATGCAGAAAAAAGGAAAAAGTTCTTGAGATGGTTG
ATTCAATTCCTTGAAAAAACTATTAGAACTCTTGATTTTAGTCCTGAAGGAATTAATTCTTTTGTT
CTTGTTAATGATTTGAAGAATTCTCCTGGGTATGGTAAGAGAGATCTTTACAAAGTTATTGACAAG
TTTCTTGAGATTCTCCAGGATAATTACCCAGAATTTGCTGCTAAACAGTTGTGCATCAATGTTTCA
TGGTGGTCTTGGCATACAACTGGATCTATTTGACTGTATTTACACCAAGGAGCAAGAGCAAGTTTG
TGTTTGCAAGCCCATCTAAAACTGCTGAGACCCTTTTCAAGTACATAGCTCCTGAGCAGGTGCCTG
TTCAATTTGGTGGGCACAGCAAGTTTGGCGAGCATGAGTTTTCCCCTGCTGATACTGT

SEQ ID NO: 64, protein - Beta vulgaris
MAEETHKPESTVAEVVVPVAEKPAEKPAEKAVLPPEAEKLAAAESAEAEKPADSAEAKIAQQVSFK
EETNVASELPELHRKALEDLKKLIQEALEKHEFSSPPPPPPPAPAKVEEKAEEKKEEQPPSTTSTT
TTTTTAVSDEVAVAPPSEEAPKTDEASPKVEEEPAKIVEQPPTTPAEEPEPAKTPEVVVAEEEKTG
EDIKETIVVEVATTTAAPVLTEPESVEETPKEAEVVVEESPKEPEEVSIWGIPLLADERSDVILLK
FLRARDYRVKDAFTMIRNTARWRKEFEVDSLLDEDLGNDYEKVVFTHGVDKQGRPVCYNVFGEFQN
KELYQNTFSDAEKRKKFLRWLIQFLEKTIRTLDFSPEGINSFVLVNDLKNSPGYGKRDLYKVIDKF
LEILQDNYPEFAAKQLCINVSWWSWHTTGSI

FIGURE 5 (continued)

SEQ ID NO: 65, DNA - Chlamydomonas reinhardtii
GTCGTGCTACTCAAGTTCTTGCGCGCACGGCAGTGGAACGTGGCGGCCGCAGTTAACATGCTTGTC
AACTGTCTGCGGTGGCGGCGCGACTTCGACGTGGCCGGCCTCGGCCTGGAGACCTTCCCGCCGCAG
CTGGCGGCGGCGGGGCAGCTCACCGGACACGACCGGGCCGGCAACCCAGTCACCTACAACTACTAC
GGCACGGGTGTGGACTTGAACGCGGTGATGGGCAGCCCGGGCGGTGTGGCCACCTTCGTGCGGTGG
CGGGTGCGGCTGATGGAGCAGGCGATTGCGCAGCTGGACTTCGAGCGCGGCGTGGAGCACGTCACG
CAGATCCACGACTACGCCGGCGCCTCCATGTTCCGCATGGACGCGGGCATCAAGTCCGCCAGCCGC
GAGATCATACGACTGTTCCAGGACAACTATCCCGAACTGCTGTCCGCCAAGCTGTTCCTCAACGTG
CCGCGGGTCATGGAGTTCCTGTTCGGCGTGTTCAGCGGCCTGGCGGACGCCGCCACCCGCGCCAAG
TTCACCATGGCCTCGCCCGCCCGC

SEQ ID NO: 66, protein - Chlamydomonas reinhardtii
VVLLKFLRARQWNVAAAVNMLVNCLRWRRDFDVAGLGLETFPPQLAAAGQLTGHDRAGNPVTYNYY
GTGVDLNAVMGSPGGVATFVRWRVRLMEQAIAQLDFERGVEHVTQIHDYAGASMFRMDAGIKSASR
EIIRLFQDNYPELLSAKLFLNVPRVMEFLFGVFSGLADAATRAKFTMASPAR

SEQ ID NO: 67, DNA - Dictyostelium discoideum
ATGAGTGGATTTATTAAAGATTTATCTCAACCTCAAAGTGAAGCTTTAAATCAATTTAAAGAATAT
TTAAATAAAAAAGAAACAATTGTGCAAATTAAATCAGATATTAAAAATAAATTACCAACAACTACA
ACAACTACAACAACTACTAATACAGAAACAGAAGAATCATCATCATCATCATCACCATCATCAAAA
GAAGAAGAAAAACACTTAAAAATTTGGAATATTAATTTAGAAAATGATTCAAAAGAGCGTGATATT
ATTTTATTAAAATTTTTACGTGCTAGAGAATTTAAAATTGAAAATTCAAAACAAATGTTAATTGAT
TGTTTAATTTGGAGAAAACAAAATCAAGTAGATGATTATGAAAAGATAGTTAATGAAGCATTTCCA
GACTATTATAAAAACATTGGTACCATTTTCAAGACTGATAAAGAGGGTAGACCAGTAATGATCAAT
CATTACCATGCAATTAATCCAGATGTTATTTTCAAAGATGGTGTGGACCAATTTGTTCGTTGGAAA
GTCCAACAAATGGAAATCGCCATTAGGGATACACTCATCCCATCGCAATGGGAAATTGAAGATTTA
ATAGTCATTCACGACTATAAAGATTGCTCATTCTTTAGAATGGATCCACGTATAAAACAAGCATCT
AATCAAACCATTCAAACCCTTCAAAATAACTACCCAGAATTTTTAGCTCGTAAATTCTTTATTAAC
ATCCCATGGTTAATGGAGAAGTTGTTCTCAATTTTCACAGTATTCACATCAGAGCGTACAAAAAGC
AAATTCATAATTTGTTCTGGAAATTATCGGGAAAAACTTTTAAAATATATTGAAGCAGATTCAATC
GCTCCAAAATTATCTGGTTTCGAAGATAACCAATCACCAATTTTAAATATTAAAATCAAACCTCAA
AAATCACATTCAATTCAATTAGGTAAACTTGATGCTGATAAAACTATTGAATGGGAATTTTGTACA
AATGAGATTGATTCTGAAATTGGTGCTAAAATTTTAATTGAACCAAATAACCAACCAACAACTTCT
AATGATATTTTATATTTTAATAATAATAGTAATAATAATAATAATAATAATAATTCACCAACACCA
AGTAATAGTAATTATCCATTCAATTGTTTCTTTCAATTGAACCAAGAGAATTTAATAGTGGTTCA
ATTCAAATTGAAGATGATTCTTATTATACTTTAGTTTTTAATAATCATTTAAATAAACAATGTGAT
TTATTTTATCGTATAACTATAAAATCAAAAACAACTCATTCTTCAACTACAACTTCAACAATCGAA
ACTTTAGGAAATTAA

SEQ ID NO: 68, protein - Dictyostelium discoideum
MSGFIKDLSQPQSEALNQFKEYLNKKETIVQIKSDIKNLPTTTTTTTTNTETEESSSSSSPSSK
EEEKHLKIWNINLENDSKERDIILLKFLRAREFKIENSKQMLIDCLIWRKQNQVDDYEKIVNEAFP
DYYKNIGTIFKTDKEGRPVMINHYHAINPDVIFKDGVDQFVRWKVQQMEIAIRDTLIPSQWEIEDL
IVIHDYKDCSFFRMDPRIKQASNQTIQTLQNNYPEFLARKFFINIPWLMEKLFSIFTVFTSERTKS
KFIICSGNYREKLLKYIEADSIAPKLSGFEDNQSPILNIKIKPQKSHSIQLGKLDADKTIEWEFCT
NEIDSEIGAKILIEPNNQPTTSNDILYFNNNSNNNNNNNSPTPSNSNYPFNCFLSIEPREFNSGS
IQIEDDSYYTLVFNNHLNKQCDLFYRITIKSKTTHSSTTTSTIETLGN

FIGURE 5 (continued)

SEQ ID NO: 69, protein - Artificial sequence - Motif 1a
L(L/T)KFLRAR

SEQ ID NO: 70, protein - Artificial sequence - Motif 2a
(L/F)(Q/E)DNYPEF

SEQ ID NO: 71, protein - Artificial sequence - SEC domain
LPELDSVVFYRGADREGHPVCYNVYGEFQDKDLYEKAFGDEEKRERFLKWRIQLLERGILSQLDFS
PSGICSMVQVTDLKNSPPMLGKHRAVTRQAVALLQDNYPEFIAKKVFINVPWWYLAANKMMSPFLT
QRTKSKFIFASPAKSAETLFRYIAPEQVPVQFGGLFK

SEQ ID NO: 72, protein - Artificial sequence - GOLD domain
SDAVTELTIKPSSKETVEIPVTENSTIGWELRVLGWEVSYGAEFTPDAEGGYTVIVQKTRKVPANE
EPIMKGSFKVGEPGKIVLTINNPASKKKKLLYRSKV

SEQ ID NO: 73, DNA - Artificial sequence - primer 1
ggggacaagtttgtacaaaaaagcaggcttaaacaatggcggaggagccac

SEQ ID NO: 74, DNA - Artificial sequence - primer 2
ggggaccactttgtacaagaaagctgggtgtggtgaatctggtgatcagg

SEQ ID NO: 75, DNA - Oryza sativa
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT

```
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC
```

FIGURE 5 (continued)

MAEIQSNGRAYESLLEKVLSMNILSSDYFKELYGLKTYHEVIDEIYNQVNHVEPW
   Motif IVb

MGGNCRGPSTAYCLLYKFFTMKLTVKQMHGLLKHTDSPYIRAVGFLYLRYVADAK
    Motif IIb

TLWTWYEPYIKDDEEFSPGPNGRMTTMGVYVRDLLLGLYYFDTLFPRIPVPVMRQ

*IVSNLEKMNLPTKPSGSTGDMTRGSEDTARRPPSVKASLSASFGQRAPHRASTRG*
 Motif Ib

*SSPVR*RPPPTGYDRNGGDEVQQRSPRRSQSRDYYSDRDSDRQREREREKDRERER

GRDRYRERERDYGNDRRSRRDYDSRSRRNDYEDDRSRHDRRSRSRSRSRSVQI

EREPTPKRDSSNKEKSAVTVNSNLAKLKDLYGDASSQKRDEGFGTRKDSSSEEVI
                    Motif IIIb

KLGGSSWR

FIGURE 6

```
                        1                                                  50
Arath_PRP38_1    (1)  ------MAEIQSNGR------------AYESLLEKVLSMNILSSDYFK-
Lyces_PRP38_1    (1)  ------MAELKTSGR------------PIDQLLEKVLCMNILSSDYFR-
Poptr_PRP38_1    (1)  -------MEIQTNGK------------PIDSLLEKVLCMNILSSDYFK-
Poptr_PRP38_2    (1)  -------MEVQTNGK------------PIDSLFEKVLCMNILSSDYFK-
Brasy_PRP38_1    (1)  -------MEIQSSGR------------PIEVLMEKVLSMNIVSSDYFK-
Sacof_PRP38_1    (1)  -------MEIQSSGR------------PIEGLMEKVLSVNILSSDYFK-
Sacof_PRP38_3    (1)  -------MEIQSSAR------------PIEGLMEKVLSVNILSSDYFK-
Brasy_PRP38_2    (1)  -------MEIQSSGR------------PIEVLMEKVLSMNIVSSDYFK-
Horvu_PRP38_1    (1)  -------MEIQTSGK------------PIDMLMEKVLCMNILSSDYFK-
Orysa_PRP38_1    (1)  -------MEIQTSGK------------PIDLLMEKVLCMNIMSSDYFK-
Chlre_PRP38_1    (1)  ---------MEIHGS------------NTTFNLENVLRQNILSSDYYKG
Ostta_PRP38_2    (1)  -----MPSVIENHGRPIWTPFGNGAATSGKSHGVEEVLRQNIAHSEYFRK
Arath_PRP38_5    (1)  MANRTDPLAKNIRGTN------------PQNLVEKIVRTKIYQHTFWK-
Medtr_PRP38_1    (1)  MANRTDPAAKSIRGTN------------PQNLVEKILRSKIYQHTYWK-
Vitvi_PRP38_1    (1)  MANRTDPAAKSIRGTN------------PQNLVEKILRSKIYQNTYWK-
Orysa_PRP38_2    (1)  MANRTDPLAKSIHGTN------------PQNLVEKIVRSKIYQSTYWK-
Triae_PRP38_1    (1)  MANRTDPRARSIHGTN------------PQNLVEKIVRAKIYQSNYWK-
Ostta_PRP38_1    (1)  ---------------------------------------------MTYWK-
Schce_PRP38_1    (1)  MAVNEFQVESNISPKQLNNQ--------SVSLVIPRLTRDKIHNSMYYKV
    Consensus    (1)        MEIQS GR             ID LMEKVL MNILSSDYFK 51                                                100
Arath_PRP38_1   (31)  -------ELYGLKTYHEVIDEIYNQVNHVEPWMGGNCRGPSTAYCLLYKF
Lyces_PRP38_1   (31)  -------DLLRLKTYHEVIDEIYNQVDHVEPWMTGNCRGPSTAFCLLYKF
Poptr_PRP38_1   (30)  -------ELYRLKTYHEVIDEIYNQVDHVEPWMTGNCRGPSTSFCLLYKF
Poptr_PRP38_2   (30)  -------ELYRLKTYHEVIDEIYNQVDNVEPWMTGNCRGPSTSFCLLYKF
Brasy_PRP38_1   (30)  -------ELYKIKTYHEVIDEIYNQVDHVEPWMTGNCRGPSTAFCLLYKL
Sacof_PRP38_1   (30)  -------ELFKYKTYHEVVDEIYNQVDHVEPWMTGNCRGPSSAFCLLYKF
Sacof_PRP38_3   (30)  -------ELFKYKTYHEVVDEIYNQVDHVEPWMTGNCRGPSSAFCLLYKF
Brasy_PRP38_2   (30)  -------ELYKIKTYHEVIDEIYNQVDHVEPWMTGNCRGPSTAFCLLYKL
Horvu_PRP38_1   (30)  -------ELYRMKTYHEVIDEIYNQVDHVEPWMTGNCRGPSTAFCLLYKF
Orysa_PRP38_1   (30)  -------ELYRLKTYHEVIDEIYNQVDHVEPWMTGNCRGPSTAFCLLYKF
Chlre_PRP38_1   (29)  -------TCSELSNCSDIVDEIYESVDHVEPWMSGNARGPSTAFCLLHRL
Ostta_PRP38_2   (46)  LRRAD-DLGRPAYDFMALVDEIYELVDHCEPWMCGNARGASTGFCILFQF
Arath_PRP38_5   (37)  --------EQCFGLTAETLVDKAMELDHLGGTFGGSRK-PTPFLCLILKM
Medtr_PRP38_1   (37)  --------EQCFGLTAETLVDKAMELDHLGGTYGGNRK-PTPFMCLVMKM
Vitvi_PRP38_1   (37)  --------EQCFGLTAETLVDKAMELDHLGGTFGGNRK-PTPFMCLVMKM
Orysa_PRP38_2   (37)  --------EQCFGLTAETLVDKAMELDHTGGTYGGNRK-PTPFLCLALKM
Triae_PRP38_1   (37)  --------EQCFGLTAETLVDKAMELDYTGGTHGGNRR-PTPFLCLALKM
Ostta_PRP38_1    (6)  --------EKCFGVSAEALVDLAVDLRSVGGIYGGNNR-ATEFLCLTLKL
Schce_PRP38_1   (43)  NLSNESLRGNTMVELLKVMIGAFGTIKGQNGHLHMMVLGGIEFKCILMKL
    Consensus   (51)          EL  LKTYHEVIDEIYNQVDHVEPWMTGNCRGPSTAFCLLYKL
```

FIGURE 7

```
                    101                                            150
Arath_PRP38_1  (74) FTMKLTVKQMHGLLKHT-----DSPYIRAVGFLYLRYVADAKTLWTWYEP
Lyces_PRP38_1  (74) FTMKLTVKQMHGLLKHP-----DSPYIRAIGFLYLRYLGDFKTLWGWYEP
Poptr_PRP38_1  (73) FTMKLTVKQMHGLLKHK-----DSPYIRAVGFLYLRYAGDPKTLWNWFEP
Poptr_PRP38_2  (73) FTMKLTVKQMHGLLKHK-----DSPYIRAVGFLYLRYAGDPKTLWNWFEP
Brasy_PRP38_1  (73) FTMKLTMNQMHGLLKHP-----DSPYIRAIGFLYLRYVAEPKTLWTWYEP
Sacof_PRP38_1  (73) FTMKLTVKQMHGLLKHQ-----DSPYIRAIGFLYLRYVAEPKTLWTWYEP
Sacof_PRP38_3  (73) FTMKLTVKQMHGLLKHQ-----DSPYIRAIGFLYLRYVAEPKTLWTWYEP
Brasy_PRP38_2  (73) FTMKLTMNQMHGLLKHP-----DSPYIRAIGFLYLRYVAEPKTLWTWYEP
Horvu_PRP38_1  (73) FTMKLTVKQMHGLLKHP-----DSPYIRAIGFLYLRYVADPKILWTWYEP
Orysa_PRP38_1  (73) FTMKLTVKQMHGLLKHP-----DSPYIRAIGFLYLRYVADPKILWTWYEP
Chlre_PRP38_1  (72) FTLKLSAKEVKGMLDHK-----DSPYIRAVGFLYLRYVGDPKTLWSWVAP
Ostta_PRP38_2  (95) CEMELSDGNVWHLLRHG-----DSPFIRALGFLYVRYVKNGRELLKWCEE
Arath_PRP38_5  (78) LQIQPEKEIVVEFIKND-----DYKYVRILGAFYLRLTGTDVDVYRYLEP
Medtr_PRP38_1  (78) LQIQPEKEIVIEFIKND-----DYKYVRILGAFYLRLTGSDTDVYHYLEP
Vitvi_PRP38_1  (78) LQIQPEKDIVVEFIKNE-----EYKYVRILGAFYLRLTGIDTDVYQYLEP
Orysa_PRP38_2  (78) LQIQPDKDIVVEFIKNE-----DYKYVRVLGAFYLRLTATVADVYQYLEP
Triae_PRP38_1  (78) LQIQPDKEIVVEFIKDE-----DYKYVRVLGAFYLRLTGTVADVYQYLEP
Ostta_PRP38_1  (47) LQIQPEKEIVLEFIKNE-----DHKYVRLLGAFYLRLVGKPTDVYRYLEP
Schce_PRP38_1  (93) IEIRPNFQQLNFLLNVKNENGFDSKYIIALLLVYARLQYYYLNGNNKNDD
    Consensus (101) FTMKLTV QMHGLLKH      DSPYIRALGFLYLRYVGDPK LW WYEP 151                                            200
Arath_PRP38_1 (119) YIKDDEEFSP-GPNGRM--TTMGVYVRDLLLGLYYFDTLFPRIPVPVMRQ
Lyces_PRP38_1 (119) YLKDDEEFSP-GSSGQM--TTMGVYVRDLFLGQYYFDTLLPRIPVPVVRT
Poptr_PRP38_1 (118) YIKDDEEFSP-GTSGRK--TTMGVYVRDLLLGQYYFDTLFPRIPVPVMRQ
Poptr_PRP38_2 (118) YIKDDEEFSP-GSSGRK--TTIGIYVRDLLLGQYYFDTLFPRIPVPVLRQ
Brasy_PRP38_1 (118) YIKDDEEFSP-GSNGKM--TTMGVYVRDVLLGQYYFDSLLPRVPLLILRQ
Sacof_PRP38_1 (118) YIKDDEEFAP-GSNGKM--TTMGVYVRDLLLGQYYFDSLLPRVPLPILRQ
Sacof_PRP38_3 (118) YIKDDEEFAP-GSNGKL--TTMGVYVRDLLLGQYYFDSLLPRVPLPILRQ
Brasy_PRP38_2 (118) YIKDDEEFSP-GSNGKM--TTMGVYVRDVLLGQVYLLKYAPTSSIKHI--
Horvu_PRP38_1 (118) YLKDDEEFSP-GSNGRM--TTMGVFVRDLILGQYYFDSILPRVPVPVVRQ
Orysa_PRP38_1 (118) YLKDDEEFSP-GSNGRM--TTMGVYVRDLILGQYYFDSLLPRVPLPVIRQ
Chlre_PRP38_1 (117) YVKDQEKFSPSGPNEKE--VAMGDYVRDLLLSQYYFETIFPRIPKPVQDQ
Ostta_PRP38_2 (140) FFGDEEKFKP-SPDGKE--VTMGAFVRDLLLEQRYFETILPRIPEVARRE
Arath_PRP38_5 (123) LYNDYRKVRQKLSDGKFSLTHVDEVIEELLTKDYSCDIAMPRLKKRWTLE
Medtr_PRP38_1 (123) LYNDYRKLRRKLPDGQFALTHVDEVIDELLTTDYSCDIAMPRIKKRWTLE
Vitvi_PRP38_1 (123) LYNDYRKLRRKLSDGNYSLTHVDEVIDELLTKDYSCDVALPRIKKRWTLE
Orysa_PRP38_2 (123) LYNDYRKIRHKLSDGKFTLTHVDEFIDDLLTKDYSCDTALPRIQKRWVLE
Triae_PRP38_1 (123) LYNDYRKIRQKLSDGKFTLTHVDEFIDELLTKDYSCGTALPRIQKRWILE
Ostta_PRP38_1  (92) LLNDYRKVRYRTRDGKYALTHVDEFVNNLLTKDMFCDVTLPRVPHRQVLE
Schce_PRP38_1 (143) DENDLIKLFKVQLYKYS--QHYFKLKSFPLQVDCFAHSYNEELCIIHIDE
    Consensus (151) YIKDDEEFSP GS GK   TTMGVYVRDLLLGQYYFDTLLPRIPV VIR
```

FIGURE 7 (continued)

```
                         201                                                250
Arath_PRP38_1    (166)   IVSNLEKMNLPTKP--SGSTGDMTR-GSEDTA-RRPPSVKASLSASFGQR
Lyces_PRP38_1    (166)   AVASLEKMNLPTKL--SGSIGDSSRGSEETSR--RPPSVKASLSVSFGQR
Poptr_PRP38_1    (165)   ITSNLEKLKLPTKI--SGSTGDGNRHGSDDTA-RRPPSVKAALSVSFGQR
Poptr_PRP38_2    (165)   ITANLEMMKLPTKI--SGSTGDGNRHGSDDTA-RRPPSVKAALSVSFGQR
Brasy_PRP38_1    (165)   VSAHLEKMKLPTKQ--SGMTGDSSRLGSDDTA-RRPPSVKASLSVSFGQR
Sacof_PRP38_1    (165)   VTSHLEKLKLPTKQ--SGMTGDSNRLESNDTA-RRPPSVKASLSVSFGQR
Sacof_PRP38_3    (165)   VTSHLEKLKLPTKQ--SGMTGDSNRLESNDTA-RRPPSVKASLSVSFGQR
Brasy_PRP38_2    (163)   -------------------------------------------------
Horvu_PRP38_1    (165)   VTANLEKMKLPTKL--SGVTGDS-RHGSEDTA-RRPPSVKASLSVSFGQR
Orysa_PRP38_1    (165)   VTSNLEKMKLPTKL--SGITGESNRHGSEDTA-RRPPSVKASLSVSFGQR
Chlre_PRP38_1    (165)   INDELTKRSLATTAKGNGGAGGADRRGMDDSGNRRPASVKASLSVAFGQR
Ostta_PRP38_2    (187)   IIKVSVAVVRAGAALLVVLSRSL--------------------------
Arath_PRP38_5    (173)   QNGLLEPRKSVLEDDFEEEEEKEENEGIADGS-----EDEMDQRRKSPER
Medtr_PRP38_1    (173)   SLGALEPRQSALEEDFEEEEENEDNEQPAEEP------EKDYNRGRSP--
Vitvi_PRP38_1    (173)   SLGTLEPRRSALEDDFEEEEEKEEDDQLMDELDVG-AHEKDYYRGRSP--
Orysa_PRP38_2    (173)   TSGTLEPRRSALEDDFEEEEDKEDEQPMDIDEPNGREKHDYRGRSP--
Triae_PRP38_1    (173)   ASGTLEPRRSALEDDFEEEEDKEDGQPMDVDEPN-THEKDHLRGRSP--
Ostta_PRP38_1    (142)   AAGALEPRVSALEEDIADLEEELESAVEEAIG-----------------
Schce_PRP38_1    (191)   LVDWLATQDHIWGIPLGKCQWNKIYNSDEESS--------SSESESNGDS
    Consensus    (201)   I G LE MKL T   SG GD R   EDTA RP SVKASLS SFGQR 251                                                300
Arath_PRP38_1    (212)   APHRASTRGSSPVRRPPP-TGYDRNGGDEV-----QQRSPRRSQSRDYYS
Lyces_PRP38_1    (212)   APHRASTRDSSPIRRTIAPPSYDKDGANGSRRSPSMRRSQSRDLSDRENS
Poptr_PRP38_1    (212)   APHRASTRDSSPVRRTIPSPSYDRTSDDSR-----SRLGQSREYSDKEYS
Poptr_PRP38_2    (212)   APHRASTRDSSPVRRTLPPPSYDRTSDDPR-----SHRSQSREYSDKEYS
Brasy_PRP38_1    (212)   APHRASTRDSSPVRKTLPSIRERERSHD-------GDRAKS---PPRKRR
Sacof_PRP38_1    (212)   APHRAYTRDSSPVRRTLPSKQDKERSYD-------GDHAKS---PPRKRR
Sacof_PRP38_3    (212)   APHRASTRDSSPVRRTLPSKQDKERSYD-------GDHAKS---PPRKRR
Brasy_PRP38_2    (163)   -------------------------------------------------
Horvu_PRP38_1    (211)   APHRASTRDSSPVRRTVTQDDQRRSSSP-------FRRSASREGPYSDRS
Orysa_PRP38_1    (212)   APHRASTRESSPVRRTVTHDGHRKSSSP-------SRRSGSREVPDRDRS
Chlre_PRP38_1    (215)   APNRSGAREEGRGRDPSLAQRDGTAAAR-------GGRGSASPEPPRDRR
Ostta_PRP38_2    (210)   -------------------------------------------------
Arath_PRP38_5    (218)   ERERDRDRR-----RDSHRHRDRDYDRD-------YDMDRDHDRDYERER
Medtr_PRP38_1    (215)   ARERDRDRR-----RDSHRHRDRDYDRE-------YDRDYDRERGRGRDR
Vitvi_PRP38_1    (220)   ARERDRDRK-----RDSHRYRDRDYDRE-------RGRGRERDRERERDR
Orysa_PRP38_2    (221)   TRDRDRER------KHERHHRDRDYDRD-------RDYGRGRERDRDRDR
Triae_PRP38_1    (220)   TKERDRERERDRDRKHERHHRDRDHDRD-------RDHDRDYGRGRERDR
Ostta_PRP38_1    (174)   -------Q----------RMNMDVDAG-------EAAAAASTRGAREDG
Schce_PRP38_1    (233)   EDDNDTSSES---------------------------------------
    Consensus    (251)   AP RA TRDS  RR         R    D              S
```

FIGURE 7 (continued)

```
                     301                                              350
Arath_PRP38_1  (256) DRDSDRQRERE--REKDRERERGRDRYRERE-------------R-----
Lyces_PRP38_1  (262) ERDRGRDRDRDRDRDRDRDRERTRDRERDRDRDRDYRDQERERDRGRDR
Poptr_PRP38_1  (257) DRDHDRGRERDQDHDRDRERDRVRDRDQERER-DRD-RERDWDQSRDRDR
Poptr_PRP38_2  (257) DRDRDQDRGRERDRDRDRERDRVRDRDHDRER-DRD-RGRDSDRK----Q
Brasy_PRP38_1  (252) SESRER------NRETERDRSD-RDRGRYN---DRE-QGRQSRDSR----
Sacof_PRP38_1  (252) SQSSER------HHDSERDRSN-RDRGKYK---DRE-HDRYARDHR----
Sacof_PRP38_3  (252) SQSSER------HHDSERDRSD-RDRGRYK---GRE-HDRYARDHR----
Brasy_PRP38_2  (163) -------------------------------------------------
Horvu_PRP38_1  (254) IHDREG---NRSSRDRDTDHSS-RDRDTVRSSRDRD-TGRSSRDRDTGLS
Orysa_PRP38_1  (255) SRDRSSRDYDRSSHDRDRDHSS-RDYDRPSHDRDRD-RDRSSRDYDRSSR
Chlre_PRP38_1  (258) EAPAPR---R--DFDRERDVRGGGGGGADR---------R---DNRDYGR
Ostta_PRP38_2  (210) -------------------------------------------------
Arath_PRP38_5  (256) GHGRDRD----RERDRD--HYRERDRDRERGRDRE------RDRRDRARR
Medtr_PRP38_1  (253) DRDRDREKERDRDRERDRDRYRLRE-EKDYGREREG----RERERRDRDR
Vitvi_PRP38_1  (258) DSYRDRE----RERDRDRDRYRLRD-DKEYGRDRE------REREREGRER
Orysa_PRP38_2  (258) ERDRDRD----RDRDRDRDRDRHRIRDEDYSRDRDRARDRDGRERERWDR
Triae_PRP38_1  (263) DRDRGRE----RDRERDRERDRHRIRDDDYHRDRD----RDGRERERRDR
Ostta_PRP38_1  (199) EIVASGS-----KRSREHDGVRYRECDDSDGDRYVR-----RRERS----
Schce_PRP38_1  (243) -------------------------------------------------
    Consensus  (301) D  RDR        RDRDRDR R RDRD D         R  RD 351                                              400
Arath_PRP38_1  (286) DYGNDRRSR--------RDYDSRSRRNDYED---------DRSRHDRRS
Lyces_PRP38_1  (312) DRDRRYDNE--------RDRERDRDRRHDYDRDRGRDRDRRYDYDRRSI
Poptr_PRP38_1  (305) DRERDRYRR--------YDYDRSSRYTDRESRRDSEQSSRDRSRHYRES
Poptr_PRP38_2  (301) ERERGRDRR--------SDYDRSSRYTDRESRRDYERSSRDGSRRHRES
Brasy_PRP38_1  (287) DRDYHRSS-------YAERDVE----RRGHERRDRNSDRNG-------RS
Sacof_PRP38_1  (287) DRDHHRQS-------YSDRDDE----RRGREKRDRDSDRKR-------YS
Sacof_PRP38_3  (287) DRDHHRQS-------YSDRDDE----RRGREKRDRDSDHNR-------HS
Brasy_PRP38_2  (163) -------------------------------------------------
Horvu_PRP38_1  (299) SRDRERDY------DRDSRDCDYYRFRHSEEKRNYRSEHDN--SRHRRSS
Orysa_PRP38_1  (303) DRDHDRDIRDYHRRDRDSRDRD-YRSRHSSERQDDRRDRDREGSRHRRSS
Chlre_PRP38_1  (291) DRDRGRDYD------KSRDYDKSRDYAKGRDYDRGRDYGRGGGAGGGGR
Ostta_PRP38_2  (210) -------------------------------------------------
Arath_PRP38_5  (294) RS--------------RSRSRDRKRHETD--------------------
Medtr_PRP38_1  (298) DRGRRRSYSR-------SRSRSRDRKDHDGGDYRKRHARSSVSP----RR
Vitvi_PRP38_1  (298) ER--------------RDRDRAIQGAEVG-ARIRHARSSTNM----PE
Orysa_PRP38_2  (304) DRGRRRSRSR------SRSRDRRERDREDGEYRRRRDRGSASP-RGHAE
Triae_PRP38_1  (305) DRGRHRSRSG------SRSRDRRERDREVGELRKRRGRGSASPPRGRAE
Ostta_PRP38_1  (235) -R--------------SRSRDRVPARRDDARPGVLASGEE--------M
Schce_PRP38_1  (243) -------------------------------------------------
    Consensus  (351) DR   R            RD DR
```

FIGURE 7 (continued)

```
                         401                                               450
Arath_PRP38_1   (318)  R---------SRSRSRSRS-------VQIEREPTPKRDSSNKEKSAVTV
Lyces_PRP38_1   (353)  ERSRRDYDRSRSRSRSRSHSRSLHDQGTRLDQQRTPPRDES---KEKKAA
Poptr_PRP38_1   (346)  SS-----YRSRSRSRSRSRSSQAGASPFDRHPTPQRDGN---KDKTSA
Poptr_PRP38_2   (342)  N------YRTRSRSRSRSRSQSLQAGTSPFDQHPTPQRDGS---KDRTSA
Brasy_PRP38_1   (319)  SA-----HRSRSRSRSPSRGRTNG---DHRRSSPFGKAPE---------
Sacof_PRP38_1   (319)  SS-----RXEQESS--PWQN------------------------------
Sacof_PRP38_3   (319)  SS-----RRSRSRS--PVRGRTDG---DKHRSSPFGRAPE---------
Brasy_PRP38_2   (163)  --------------------------------------------------
Horvu_PRP38_1   (341)  SC-----HRSRSRSRSRSRSR------NEHRSSPFG-------------
Orysa_PRP38_1   (352)  SR-----HRSRSRSRSRSRSRSRSRNEERSSPFGNAGKE----KTAAI
Chlre_PRP38_1   (334)  GYDDRRDERRRSRSRSRSRDR--------------N--G----------
Ostta_PRP38_2   (210)  --------------------------------------------------
Arath_PRP38_5   (309)  DVR----DREEPKKKKEKKEKMK--------EDGTDHPNPEIAEMNRLRA
Medtr_PRP38_1   (337)  DGA----EDGEPKKKKEKKEKKEKK------DDGTDHPDPEIAEANRIRA
Vitvi_PRP38_1   (327)  DGT----TREEPRKKKEKKEKK---------DDGTDHPDPEIAEANRLRA
Orysa_PRP38_2   (346)  DGG----SRDEPKKRKEKKEKKGE-------GNAPDPNDPEIIEMNKLRA
Triae_PRP38_1   (348)  DG-----PREEPKKRKEKKEKKGS-------GNGPDPNDPEIIEMNKLRA
Ostta_PRP38_1   (261)  DHR----EKKEKKEKKEKREKK---------EK--TEMDPEIAEANAIRA
Schce_PRP38_1   (243)  --------------------------------------------------
    Consensus   (401)              R   RSR    R R 451                                          495
Arath_PRP38_1   (351)  NSNLAKLKDLYGDASSQKRDEGFG--TRKDSSSEEVIKLGGSSWR
Lyces_PRP38_1   (400)  SSNLAKLKDLYGDFGNKKENIGDDRAPNRDTSTEEVIRLGGSTWR
Poptr_PRP38_1   (388)  PSNLAKLKDLYGDLSDQKGDAGLERVPRRDNDGEEVFRLGGSTWR
Poptr_PRP38_2   (383)  SSNLAKLKDLYGDLGDQKGDAGLERGPRRDNDGEEVFRLGGSTWR
Brasy_PRP38_1   (351)  SSNLAKLKDLYGDASNAKEDAGD-GRARRDSGAEEVIRLGGARWR
Sacof_PRP38_1   (332)  ---------------------------------------------
Sacof_PRP38_3   (349)  SSNLAKLKDLYGDATNTKNDAGD-DRAHRDSGTEEVIRLGGARWR
Brasy_PRP38_2   (163)  ---------------------------------------------
Horvu_PRP38_1   (366)  ---------------------------------------------
Orysa_PRP38_1   (393)  SSNLAKLKDLYGDVTEKKDDG---EAPRRDSCAEEVIRLGGPRWR
Chlre_PRP38_1   (357)  -GGARDARDVFKDARR-----------------------------
Ostta_PRP38_2   (210)  ---------------------------------------------
Arath_PRP38_5   (347)  SLGMKPLRD------------------------------------
Medtr_PRP38_1   (377)  SLGLKPLKM------------------------------------
Vitvi_PRP38_1   (364)  SLGLKPLKL------------------------------------
Orysa_PRP38_2   (385)  SLGLKPLK-------------------------------------
Triae_PRP38_1   (386)  SIGLGPLK-------------------------------------
Ostta_PRP38_1   (296)  KLGLKPLRG------------------------------------
Schce_PRP38_1   (243)  ---------------------------------------------
    Consensus   (451)  S  L  LK
```

FIGURE 7 (continued)

SEQ ID NO: 76, DNA - Arabidopsis thaliana
ATGGCGGAGATACAGTCAAATGGAAGGGCATATGAGTCATTATTGGAAAAGGTTCTTTCAATGAA
CATTCTTTCTTCTGACTATTTTAAAGAGCTCTATGGTTTAAAGACTTATCATGAGGTAATTGATG
AAATCTACAACCAAGTTAATCATGTGGAGCCGTGGATGGGTGGGAATTGCCGTGGTCCTTCAACA
GCGTATTGTCTTCTCTACAAATTCTTTACCATGAAACTTACAGTGAAGCAGATGCATGGACTGTT
AAAGCACACAGATTCTCCTTATATTAGAGCGGTTGGATTCCTATATTTAAGATATGTTGCAGATG
CAAAGACGTTGTGGACATGGTATGAACCATACATTAAAGATGATGAGGAGTTTTCACCAGGACCA
AATGGACGGATGACGACAATGGGTGTTTATGTACGTGATTTGCTGCTTGGACTGTACTACTTTGA
TACTTTGTTTCCTCGTATACCTGTTCCTGTCATGCGCCAGATTGTATCAAACCTTGAGAAGATGA
ATTTACCAACTAAACCTTCTGGTTCAACCGGAGACATGACCCGTGGCTCAGAAGACACTGCCCGT
CGTCCACCATCAGTAAAAGCATCCCTCTCTGCTTCATTTGGTCAGCGTGCACCTCATCGTGCTTC
CACCAGAGGCTCTTCTCCTGTTCGCCGTCCTCCACCGACTGGTTATGACAGAAATGGAGGCGATG
AAGTACAACAGCGGTCCCCACGTAGAAGCCAGAGCCGAGACTATTATTCTGACAGAGACTCAGAT
AGACAACGGGAAAGAGAGAGGGAGAAAGACCGCGAAAGAGAGAGGGGGAGGGATAGATACAGAGA
AAGGGAAAGGGATTATGGTAATGATAGGAGATCAAGGCGTGACTATGATAGTAGAAGCAGGCGCA
ATGATTATGAGGACGACAGAAGTAGACATGACCGGAGAAGCAGGAGCAGAAGCAGAAGTAGGAGC
AGGAGTGTGCAGATTGAGCGTGAACCGACTCCTAAAAGAGATAGTAGCAACAAAGAGAAATCGGC
GGTGACAGTGAACAGCAATCTCGCAAAGCTAAAAGATTTGTATGGAGACGCAAGTAGTCAGAAAA
GGGATGAAGGATTTGGAACAAGGAAAGATTCAAGTTCAGAAGAAGTGATAAAGCTTGGTGGTTCC
TCTTGGAGGTGA

SEQ ID NO: 77, protein - Arabidopsis thaliana
MAEIQSNGRAYESLLEKVLSMNILSSDYFKELYGLKTYHEVIDEIYNQVNHVEPWMGGNCRGPST
AYCLLYKFFTMKLTVKQMHGLLKHTDSPYIRAVGFLYLRYVADAKTLWTWYEPYIKDDEEFSPGP
NGRMTTMGVYVRDLLLGLYYFDTLFPRIPVPVMRQIVSNLEKMNLPTKPSGSTGDMTRGSEDTAR
RPPSVKASLSASFGQRAPHRASTRGSSPVRRPPPTGYDRNGGDEVQQRSPRRSQSRDYYSDRDSD
RQREREREKDRERERGRDRYRERERDYGNDRRSRRDYDSRSRRNDYEDDRSRHDRRSRSRSRSRS
RSVQIEREPTPKRDSSNKEKSAVTVNSNLAKLKDLYGDASSQKRDEGFGTRKDSSSEEVIKLGGS
SWR

SEQ ID NO: 78, DNA - Arabidopsis thaliana
ATGGCGGAGATACAGTCAAATGGAAGGGCATATGAGTCATTATTGGAAAAGGTTCTTTCAATGAA
CATTCTTTCTTCTGACTATTTTAAAGAGCTCTATGGTTTAAAGACTTATCATGAGGTAATTGATG
AAATCTACAACCAAGTTAATCATGTGGAGCCGTGGATGGGTGGGAATTGCCGTGGTCCTTCAACA
GCGTATTGTCTTCTCTACAAATTCTTTACCATGAAACTTACAGTGAAGCAGATGCATGGACTGTT
AAAGCACACAGATTCTCCTTATATTAGAGCGGTTGGATTCCTATATTTAAGATATGTTGCAGATG
CAAAGACGTTGTGGACATGGTATGAACCATACATTAAAGATGATGAGGAGTTTTCACCAGGATCA
AATGGACGGATGACGACAATGGGTGTTTATGTACGTGATTTGCTGCTTGGACTGTACTACTTTGA
TACTTTGTTTCCTCGTATACCTGTTCCTGTCATGCGCCAGATTGTATCAAACCTTGAGAAGATGA
ATTTACCAACTAAACCTTCTGGTTCAACCGGAGACATGACCCGTGGCTCAGAAGACACTGCCCGT
CGTCCACCATCAGTAAAAGCATCCCTCTCTGTTTCATTTGGTCAGCGTGCACCTCATCGTGCTTC
CACCAGAGGCTCTTCTCCTGTTCGCCGTCCTCCACCGACTGGTTATGACAGAAATGGAGGCGATG
AAGTACAACAGCGGTCCCCACGTAGAAGCCAGAGCCGAGACTATTATTCTGACAGAGACTCAGAT

FIGURE 10

AGACAACGGGAAAGAGAGAGGGAGAAAGACCGCGAAAGAGAGAGGGGGAGGGATAGATACAGAGA
AAGGGAAAGGGATTATGGTAATGATAGGAGATCAAGGCGTGACTATGATAGTAGAAGCAGGCGCA
ATGATTATGAGGACGACAGAAGTAGACATGACCGGAGAAGCAGGAGCAGAAGCAGAAGTAGGAGC
AGGAGTGTGCAGATTGAGCGTGAACCGACTCCTAAAAGAGATAGTAGCAACAAAGAGAAATCGGC
GGTGACAGTGAACAGCAATCTCGCAAAGCTAAAAGATTTGTATGGAGACGCAAGTAGTCAGAAAA
GGGATGAAGGATTTGGAACAAGGAAAGATTCAAGTTCAGAAGAAGTGATAAAGCTTGGTGGTTCC
TCTTGGAGGTGA

SEQ ID NO: 79, protein - Arabidopsis thaliana
MAEIQSNGRAYESLLEKVLSMNILSSDYFKELYGLKTYHEVIDEIYNQVNHVEPWMGGNCRGPST
AYCLLYKFFTMKLTVKQMHGLLKHTDSPYIRAVGFLYLRYVADAKTLWTWYEPYIKDDEEFSPGS
NGRMTTMGVYVRDLLLGLYYFDTLFPRIPVPVMRQIVSNLEKMNLPTKPSGSTGDMTRGSEDTAR
RPPSVKASLSVSFGQRAPHRASTRGSSPVRRPPPTGYDRNGGDEVQQRSPRRSQSRDYYSDRDSD
RQREREREKDRERERGRDRYRERERDYGNDRRSRRDYDSRSRRNDYEDDRSRHDRRSRSRSRSRS
RSVQIEREPTPKRDSSNKEKSAVTVNSNLAKLKDLYGDASSQKRDEGFGTRKDSSSEEVIKLGGS
SWR

SEQ ID NO: 80, DNA - Arabidopsis thaliana
ATGGCGGAGATACAGTCAAATGGAAGGGCATATGAGTCATTATTGGAAAAGGTTCTTTCAATGAA
CATTCTTTCTTCTGACTATTTTAAAGAGCTCTATGGTTTAAAGACTTATCATGAGGTAATTGATG
AAATCTACAACCAAGTTAATCATGTGGAGCCGTGGATGGGTGGGAATTGCCGTGGTCCTTCAACA
GCGTATTGTCTTCTCTACAAATTCTTTACCATGAAACTTACAGTGAAGCAGATGCATGGACTGTT
AAAGCACACAGATTCTCCTTATATTAGAGCGGTTGGATTCCTATATTTAAGATATGTTGCAGATG
CAAAGACGTTGTGGACATGGTATGAACCATACATTAAAGATGATGAGGAGTTTTCACCAGGATCA
AATGGACGGATGACGACAATGGGTGTTTATTACTACTTTGATACTTTGTTTCCTCGTATACCTGT
TCCTGTCATGCGCCAGATTGTATCAAACCTTGAGAAGATGAATTTACCAACTAAACCTTCTGGTT
CAACCGGAGACATGACCCGTGGCTCAGAAGACACTGCCCGTCGTCCACCATCAGTAAAAGCATCC
CTCTCTGTTTCATTTGGTCAGCGTGCACCTCATCGTGCTTCCACCAGAGGCTCTTCTCCTGTTCG
CCGTCCTCCACCGACTGGTTATGACAGAAATGGAGGCGATGAAGTACAACAGCGGTCCCCACGTA
GAAGCCAGAGCCGAGACTATTATTCTGACAGAGACTCAGATAGACAACGGGAAAGAGAGAGGGAG
AAAGACCGCGAAAGAGAGAGGGGGAGGGATAGATACAGAGAAAGGGAAAGGGATTATGGTAATGA
TAGGAGATCAAGGCGTGACTATGATAGTAGAAGCAGGCGCAATGATTATGAGGACGACAGAAGTA
GACATGACCGGAGAAGCAGGAGCAGAAGCAGAAGTAGGAGCAGGAGTGTGCAGATTGAGCGTGAA
CCGACTCCTAAAAGAGATAGTAGCAACAAAGAGAAATCGGCGGTGACAGTGAACAGCAATCTCGC
AAAGCTAAAAGATTTGTATGGAGACGCAAGTAGTCAGAAAAGGGATGAAGGATTTGGAACAAGGA
AAGATTCAAGTTCAGAAGAAGTGATAAAGCTTGGTGGTTCCTCTTGGAGGTGA

SEQ ID NO: 81, protein - Arabidopsis thaliana
MAEIQSNGRAYESLLEKVLSMNILSSDYFKELYGLKTYHEVIDEIYNQVNHVEPWMGGNCRGPST
AYCLLYKFFTMKLTVKQMHGLLKHTDSPYIRAVGFLYLRYVADAKTLWTWYEPYIKDDEEFSPGS
NGRMTTMGVYYYFDTLFPRIPVPVMRQIVSNLEKMNLPTKPSGSTGDMTRGSEDTARRPPSVKAS
LSVSFGQRAPHRASTRGSSPVRRPPPTGYDRNGGDEVQQRSPRRSQSRDYYSDRDSDRQRERERE
KDRERERGRDRYRERERDYGNDRRSRRDYDSRSRRNDYEDDRSRHDRRSRSRSRSRSVQIERE
PTPKRDSSNKEKSAVTVNSNLAKLKDLYGDASSQKRDEGFGTRKDSSSEEVIKLGGSSWR

FIGURE 10 (continued)

SEQ ID NO: 82, DNA - Arabidopsis thaliana
CAAACCTTGAGAAGATGAATTTACCAACTAAACCTTCTGGTTCAACCGGAGACATGACCCGTGGC
TCAGAAGACACTGCCCGTCGTCCACCATCAGTAAAAGCATCTCTCTCTGTTTCATTTGGTCAGCG
TGCACCTCATCGTGCTTCCACCAGAGGCTCTTCTCCTGTTCGCCGTCCTCCACCGACTGGTTATG
ACAGAAATGGAGGCGATGAAGTACAACAGCGGTCCCCACGTAGAAGCCAGAGCCGAGACTATTAT
TCTGACAGAGACTCAGATAGACAACGGGAAAGAGAGAGGGAGAAAGACCGCGAAAGAGAGAGGGG
GAGGGATAGATACAGAGAAAGGGAGAGGGATTATGGTAATGATAGGAGATCAAGGCGCGACTATG
ATAGTAGAAGCAGGCGCAATGATTATGAGGACGACAGAAGTAGACATGACCGGAGAAGCAGGAGC
AGAAGCAGAAGTAGGAGCAGGAGTGTGCAGATTGAGCGTGAACCGACTCCTAAAAGAGATAGTAG
CAACAAAGAGAAATCGGCGGTGACAGTGAACAGCAATCTCGCAAAGCTAAAAGATTTGTATGGAG
ACGCAAGTAGTCAGAAAAGGGATGAAGGATTTGGAACAAGGAAAGATTCAAGTTCAGAAGAAGTG
ATAAAGCTTGGTGGTTCCTCTTGGAGGTGA

SEQ ID NO: 83, protein - Arabidopsis thaliana
NLEKMNLPTKPSGSTGDMTRGSEDTARRPPSVKASLSVSFGQRAPHRASTRGSSPVRRPPPTGYD
RNGGDEVQQRSPRRSQSRDYYSDRDSDRQREREREKDRERERGRDRYRERERDYGNDRRSRRDYD
SRSRRNDYEDDRSRHDRRSRSRSRSRSRSVQIEREPTPKRDSSNKEKSAVTVNSNLAKLKDLYGD
ASSQKRDEGFGTRKDSSSEEVIKLGGSSWR

SEQ ID NO: 84, DNA - Arabidopsis thaliana
ATGGCAAACAGAACAGATCCGTTGGCAAAGAATATAAGAGGAACGAATCCGCAGAATCTGGTAGA
GAAGATTGTGCGAACGAAGATTTATCAGCACACCTTTTGGAAGGAGCAGTGCTTTGGTCTCACGG
CGGAGACATTGGTGGACAAAGCTATGGAGCTCGACCATCTAGGTGGTACCTTTGGTGGTAGCCGC
AAGCCTACTCCGTTCCTTTGCCTCATATTGAAGATGCTTCAAATCCAGCCTGAGAAGGAAATTGT
CGTGGAGTTCATAAAAAATGATGACTACAAATATGTTCGTATTCTTGGTGCGTTCTATCTGCGTC
TCACTGGGACTGATGTTGATGTCTATCGCTACCTCGAACCTCTCTACAATGACTACCGGAAAGTG
AGACAAAAGTTATCTGATGGGAAGTTTTCGCTGACACATGTGGACGAAGTCATTGAGGAACTTCT
AACCAAGGATTATTCTTGTGATATTGCAATGCCACGTTTGAAGAAAAGGTGGACGCTTGAACAGA
ATGGTTTATTAGAGCCAAGGAAAAGTGTTTTGGAAGACGACTTTGAAGAAGAGGAAGAAAAGGAG
GAGAATGAAGGGATTGCTGATGGATCTGAAGATGAGATGGATCAGCGCCGTAAGAGTCCTGAAAG
AGAAAGAGAAAGAGACAGAGACAGGAGACGCGACAGTCATAGACACAGGGATCGTGATTATGACA
GAGACTATGATATGGATCGAGATCATGACAGAGACTATGAAAGAGAACGTGGGCATGGTCGAGAC
CGGGATAGGGAGAGAGACAGGGATCACTATAGAGAGCGAGATAGGGACAGGGAAAGAGGCAGAGA
TAGAGAACGAGACAGAAGAGACAGGGCAAGGCGCAGAAGTAGAAGCAGGAGTAGGGATCGTAAGA
GACATGAAACTGATGATGTGCGGGATCGGGAAGAACCTAAGAAAAAGAAAGAAAAGAAGGAGAAG
ATGAAGGAAGATGGAACCGATCATCCAAATCCTGAAATTGCAGAGATGAATAGACTGAGAGCATC
ACTGGGAATGAAACCCCTCAGGGACTGA

SEQ ID NO: 85, protein - Arabidopsis thaliana
MANRTDPLAKNIRGTNPQNLVEKIVRTKIYQHTFWKEQCFGLTAETLVDKAMELDHLGGTFGGSR
KPTPFLCLILKMLQIQPEKEIVVEFIKNDDYKYVRILGAFYLRLTGTDVDVYRYLEPLYNDYRKV
RQKLSDGKFSLTHVDEVIEELLTKDYSCDIAMPRLKKRWTLEQNGLLEPRKSVLEDDFEEEEKE
ENEGIADGSEDEMDQRRKSPERERERDRDRRRDSHRHRDRDYDRDYDMDRDHDRDYERERGHGRD
RDRERDRDHYRERDRDRERGRDRERDRRDRARRRSRSRSRDKRHETDDVRDREEPKKKKEKKEK
MKEDGTDHPNPEIAEMNRLRASLGMKPLRD FIGURE 10 (continued)

SEQ ID NO: 86, DNA - Brachypodium sylvaticum
ATGGAGATACAGTCGTCCGGGAGGCCCATCGAGGTGCTCATGGAGAAGGTGCTGTCCATGAACAT
CGTCTCCTCGGACTACTTCAAGGAGCTCTACAAGATCAAGACGTACCACGAGGTCATCGACGAGA
TCTACAACCAGGTCGACCACGTCGAGCCGTGGATGACCGGCAACTGCCGCGGCCCATCCACCGCC
TTCTGCCTCCTCTACAAGCTCTTCACCATGAAGCTCACCATGAACCAGATGCACGGCCTGCTCAA
GCACCCTGATTCCCCTTACATCAGAGCTATTGGATTTCTCTACCTACGATACGTTGCGGAACCAA
AGACGCTATGGACTTGGTATGAGCCCTACATTAAAGATGATGAGGAGTTTTCCCCTGGGTCGAAT
GGTAAAATGACAACTATGGGCGTTTATGTGCGTGATGTCCTCCTTGGCCAGTACTACTTCGACAG
TCTTCTTCCGCGAGTGCCTCTCCTAATTTTGCGACAGGTCAGTGCCCATCTTGAGAAGATGAAGC
TCCCAACAAAGCAGTCAGGGATGACTGGGGATTCAAGTCGCCTTGGTTCAGATGATACTGCCCGG
CGTCCTCCTTCGGTGAAGGCCTCTTTGTCTGTCTCTTTTGGTCAGCGTGCGCCACACCGTGCGTC
CACAAGGGACTCGTCTCCAGTTCGAAAGACATTGCCTTCTATACGGGAAAGGGAAAGGAGTCATG
ACGGTGATCGTGCAAAATCTCCACCCAGGAAGCGCCGAAGTGAAAGTCGGGAGCGTAATCGTGAA
ACTGAGAGGGACCGTTCGGATCGTGATCGTGGTAGATATAACGATAGAGAACAAGGTCGGCAAAG
CCGTGACAGCAGAGATCGTGATTACCATCGTTCGAGCTATGCAGAAAGAGATGTTGAAAGACGAG
GCCATGAAAGGAGGGACAGGAACTCTGATCGAAATGGACGTTCGAGCGCCCACAGAAGCAGGAGT
AGGAGCAGGAGTCCAAGCCGTGGCAGAACCAACGGGGACCACCGTCGCTCTAGCCCATTTGGTAA
AGCACCCGAGTCATCCAACTTGGCTAAGTTGAAGGATCTTTACGGCGATGCGTCAAATGCAAAGG
AAGATGCAGGCGATGGTAGAGCTCGCAGGGATTCCGGAGCTGAAGAGGTAATCAGATTGGGAGGT
GCAAGGTGGAGGTGA

SEQ ID NO: 87, protein - Brachypodium sylvaticum
MEIQSSGRPIEVLMEKVLSMNIVSSDYFKELYKIKTYHEVIDEIYNQVDHVEPWMTGNCRGPSTA
FCLLYKLFTMKLTMNQMHGLLKHPDSPYIRAIGFLYLRYVAEPKTLWTWYEPYIKDDEEFSPGSN
GKMTTMGVYVRDVLLGQYYFDSLLPRVPLLILRQVSAHLEKMKLPTKQSGMTGDSSRLGSDDTAR
RPPSVKASLSVSFGQRAPHRASTRDSSPVRKTLPSIRERERSHDGDRAKSPPRKRRSESRERNRE
TERDRSDRDRGRYNDREQGRQSRDSRDRDYHRSSYAERDVERRGHERRDRNSDRNGRSSAHRSRS
RSRSPSRGRTNGDHRRSSPFGKAPESSNLAKLKDLYGDASNAKEDAGDGRARRDSGAEEVIRLGG
ARWR

SEQ ID NO: 88, DNA - Brachypodium sylvaticum
ATGGAGATACAGTCGTCCGGGAGGCCCATCGAGGTGCTCATGGAGAAGGTGCTGTCCATGAACAT
CGTCTCCTCGGACTACTTCAAGGAGCTCTACAAGATCAAGACGTACCACGAGGTCATCGACGAGA
TCTACAACCAGGTCGACCACGTCGAGCCGTGGATGACCGGCAACTGCCGCGGCCCATCCACCGCC
TTCTGCCTCCTCTACAAGCTCTTCACCATGAAGCTCACCATGAACCAGATGCACGGCCTGCTCAA
GCACCCTGATTCCCCTTACATCAGAGCTATTGGATTTCTCTACCTACGATACGTTGCGGAACCAA
AGACGCTATGGACTTGGTATGAGCCCTACATTAAAGATGATGAGGAGTTTTCCCCTGGGTCGAAT
GGTAAAATGACAACTATGGGCGTTTATGTGCGTGATGTCCTCCTTGGCCAGGTATATCTCTTAAA
GTATGCTCCCACTTCTTCCATTAAACATATTTGA

SEQ ID NO: 89, protein - Brachypodium sylvaticum
MEIQSSGRPIEVLMEKVLSMNIVSSDYFKELYKIKTYHEVIDEIYNQVDHVEPWMTGNCRGPSTA
FCLLYKLFTMKLTMNQMHGLLKHPDSPYIRAIGFLYLRYVAEPKTLWTWYEPYIKDDEEFSPGSN
GKMTTMGVYVRDVLLGQVYLLKYAPTSSIKHI FIGURE 10 (continued)

SEQ ID NO: 90, DNA - Chlamydomonas reinhardtii
ATGGAAATCCATGGCTCCAACACCACCTTCAACCTCGAGAACGTGCTGCGTCAAAACATCCTGAG
CTCGGACTACTACAAGGGGACCTGCTCGGAACTGAGCAACTGTTCAGACATTGTGGACGAAATCT
ACGAGTCTGTCGATCATGTGGAACCTTGGATGAGCGGCAACGCGCGCGGGCCTTCCACGGCCTTC
TGCCTTCTGCACCGCCTCTTCACGCTCAAGCTCTCAGCAAAGGAGGTGAAAGGCATGCTGGACCA
CAAGGACTCTCCCTACATCCGCGCAGTGGGCTTCCTGTACCTGCGCTACGTGGGGGACCCGAAGA
CGCTGTGGAGCTGGGTGGCGCCGTACGTGAAGGATCAGGAGAAATTTCGCCGAGCGGGCCGAAC
GAGAAGGAGGTGGCCATGGGCGACTACGTACGTGACCTGCTGCTCTCCCAGTACTACTTCGAGAC
CATCTTCCCGCGCATCCCGAAGCCCGTGCAAGACCAAATCAACGACGAGCTGACGAAGCGCAGCC
TGGCCACGACGGCCAAGGGCAATGGCGGCGCCGGCGGCGCTGACCGCCGCGGCATGGACGACTCC
GGCAACCGTCGACCCGCCTCGGTGAAGGCGTCGCTGTCGGTCGCGTTCGGCCAGCGCGCGCCCAA
CCGCTCCGGTGCTCGCGAGGAGGGTCGCGGCCGGGACCCATCGCTTGCGCAGCGCGACGGCACTG
CAGCGGCTCGCGGCGGCCGCGGCTCCGCCTCGCCGGAGCCGCCACGCGACCGGCGGGAGGCGCCG
GCACCGCGGCGGGATTTCGACCGGGAGCGGGACGTGCGCGGAGGCGGTGGTGGCGGCGCTGACCG
CCGTGACAACCGGGACTACGGCCGCGACCGGGACCGTGGTCGCGACTACGACAAGAGCCGGGATT
ATGACAAGAGCCGGGATTACGCCAAGGGCAGGGACTATGACCGGGGGCGGGACTACGGGCGCGGC
GGTGGCGCTGGTGGTGGCGGCCGCGGCTACGATGACCGCCGGGACGAACGGCGGCGCAGCCGGAG
CCGGAGCCGCAGCCGGGACCGCAACGGCGGCGGTGCTCGGGACGCGCGCGATGTATTCAAGGACG
CCCGGCGGTAG

SEQ ID NO: 91, protein - Chlamydomonas reinhardtii
MEIHGSNTTFNLENVLRQNILSSDYYKGTCSELSNCSDIVDEIYESVDHVEPWMSGNARGPSTAF
CLLHRLFTLKLSAKEVKGMLDHKDSPYIRAVGFLYLRYVGDPKTLWSWVAPYVKDQEKFSPSGPN
EKEVAMGDYVRDLLLSQYYFETIFPRIPKPVQDQINDELTKRSLATTAKGNGGAGGADRRGMDDS
GNRRPASVKASLSVAFGQRAPNRSGAREEGRGRDPSLAQRDGTAAARGGRGSASPEPPRDRREAP
APRRDFDRERDVRGGGGGGADRRDNRDYGRDRDRGRDYDKSRDYDKSRDYAKGRDYDRGRDYGRG
GGAGGGGRGYDDRRDERRRSRSRSRSRDRNGGGARDARDVFKDARR

SEQ ID NO: 92, DNA - Hordeum vulgare
ATTCGGCACGAGGCCTCCCCTTTCCTCGCCTCCTTCATCCATACTCCGGCGATCTCCCAGCTACC
GTCGAATCCCAAACATCACACCCTCCGCCGTCGCCGAAGCCGATACGAGTTCATCCTCTACAGAG
AGTCGTCATCCCCTCTGGTTTGGGGGTCTCCGCAAGCCGCCCTCGCTCTCGGAAGCCAAGGAGGT
CGTAGGGTTTGCGCGCATCCTCCGTGTTTGTGTTCGCTGAAATATGGAGATACAGACTTCAGGAA
AGCCCATCGATATGTTGATGGAGAAGGTTCTTTGTATGAATATTCTTTCTTCTGATTACTTCAAG
GAGCTCTACAGGATGAAGACCTATCATGAGGTCATTGACGAGATCTATAACCAAGTTGATCATGT
GGAGCCTTGGATGACTGGCAATTGCAGGGGTCCTTCCACTGCATTTTGTCTCCTGTACAAGTTCT
TCACAATGAAGCTTACTGTGAAACAGATGCATGGTTTGTTGAAGCATCCTGACTCCCCGTACATT
AGAGCTATAGGATTTTGTATCTTCGATATGTTGCAGATCCAAAGATCCTATGGACATGGTATGA
GCCCTACTTGAAGGATGATGAGGAATTCTCCCCTGGATCTAATGGTCGCATGACAACCATGGGTG
TATTTGTGCGTGATCTTATACTTGGACAGTACTACTTTGATAGTATCCTTCCAAGAGTTCCTGTT
CCAGTAGTTCGTCAAGTAACAGCCAATCTTGAGAAGATGAAGCTGCCTACCAAGCTTTCTGGGGT
GACTGGAGACAGTCGCCACGGATCAGAGGATACTGCCCGTCGCCCCCTTCTGTTAAAGCTTCTT
TGTCAGTTTCTTTTGGACAGCGTGCGCCACACCGTGCTTCCACACGGGATTCTTCCCCAGTGCGA CGAACAGTCACCCAAGATGATCAACGGAGATCATCTTCCCCATTTCGTCGTAGTGCAAGTCGGGA
GGGGCCTTACAGTGACCGTTCAATTCACGACCGAGAAGGTAACCGTTCAAGCCGTGACCGAGATA
CTGACCATTCAAGCCGTGACCGAGATACTGTCCGTTCAAGCCGTGACCGAGATACTGGCCGTTCA
AGCCGTGACCGAGATACTGGCCTTTCAAGCCGTGACAGAGAGCGTGATTATGACCGTGACAGCAG
GGATTGTGACTATTACAGGTTCAGGCATTCAGAAGAAAAAAGGAATTACCGAAGCGAACATGACA
ATAGTAGACACAGACGCTCCAGCTCATGTCATAGGAGCAGAAGCCGGAGTCGGAGCAGGAGCAGG
AGCAGGAATGAGCATCGTTCCAGTCCATTTGGGGATACAAGCAAAGAGAAGGCTGCTGCTGCCTC
GAGCAACCTAGCTAAGCTGAAAGACCTGTACGGCGACGTAGCTGAGAAGAAGGATGATGGTGATG
CCAGGCGGCTTCACCATGATTCATGTGCCGAAGAGGTTATTAGGTTGGGAGGCCCTAGGTGGAGA
TAAATATGAACCGCCGACTCTGTCATCCAGGTCATGCTGTTACTGCACCGTTCGATTTACCTGCT
TTTGCATTGACATTAGTGAGATCACTCTTTGTAAACACTCGGTACTTTATGTGGTTCATTAATCC
ATATCTTTTGGACGTGCAGTCAATCTATCAAATTCATCAACGTAAAAAAAG

SEQ ID NO: 93, protein - Hordeum vulgare
MEIQTSGKPIDMLMEKVLCMNILSSDYFKELYRMKTYHEVIDEIYNQVDHVEPWMTGNCRGPSTA
FCLLYKFFTMKLTVKQMHGLLKHPDSPYIRAIGFLYLRYVADPKILWTWYEPYLKDDEEFSPGSN
GRMTTMGVFVRDLILGQYYFDSILPRVPVPVVRQVTANLEKMKLPTKLSGVTGDSRHGSEDTARR
PPSVKASLSVSFGQRAPHRASTRDSSPVRRTVTQDDQRRSSSPFRRSASREGPYSDRSIHDREGN
RSSRDRDTDHSSRDRDTVRSSRDRDTGRSSRDRDTGLSSRDRERDYDRDSRDCDYYRFRHSEEKR
NYRSEHDNSRHRRSSSCHRSRSRSRSRSRSRNEHRSSPFG

SEQ ID NO: 94, DNA - Lycopersicum esculentum
GAGCTTTTGTATCCCCTCGATCTCCGGTTCCTCTCTCCTTCTTCTTCTCTTCGTCGTCAATTTTC
CATTTTCCCTCATCGATTCTCCGGCGGAAAACCGAAAAAAGGTAATTCATAATCTGAACCTAAAC
CTTTTCCGATATCATTTTTATTGTTGGCCACAGAAGGTAGGAAAAGATAACACTCTGGTGTCCAA
GTCACTAAGGGCATGGCTGAGCTTAAGACTTCTGGGAGACCTATAGACCAGTTGTTGGAGAAGGT
TCTCTGCATGAACATTCTATCTTCTGATTACTTCAGAGACCTTTTGCGCCTGAAAACTTATCATG
AAGTGATTGATGAAATCTATAATCAAGTTGACCATGTGGAACCATGGATGACTGGCAACTGTCGT
GGTCCTTCAACAGCCTTCTGCCTTCTCTACAAGTTCTTCACAATGAAACTTACTGTCAAGCAAAT
GCATGGCCTGTTAAAGCATCCAGATTCTCCTTACATTAGAGCTATTGGGTTCCTTTATCTGAGAT
ATCTTGGTGATTTTAAGACATTATGGGGTTGGTATGAGCCTTACCTCAAAGATGATGAGGAATTC
TCTCCTGGATCCAGTGGGCAAATGACCACAATGGGTGTATATGTGCGTGACTTATTCTCGGGCA
GTATTATTTTGACACACTACTACCCCGCATTCCTGTTCCTGTCGTGCGGACAGCAGTTGCCAGTC
TCGAAAAAATGAATCTGCCGACCAAACTTTCTGGGTCGATTGGGGATTCTAGTCGTGGATCTGAG
GAAACTTCTCGCCGGCCACCTTCTGTCAAAGCTTCCCTTTCAGTGTCCTTTGGTCAGCGGGCACC
TCATCGTGCATCAACTAGAGATTCATCTCCCATCCGAAGAACAATTGCACCACCATCCTATGATA
AGGATGGTGCAAATGGTTCAAGACGTTCCCCCAGCATGCGCCGGAGTCAAAGCCGTGATTTATCT
GACCGGGAAAATTCTGAAAGGGACAGGGGCCGGGACCGGGACAGGGACAGGGACAGGGACAGGGA
CAGGGACAGGGAAAGAACTAGGGACAGAGAACGTGATAGGGATAGGGATAGGGATAGGTATAGGG
ACCAGGAAAGAGAAAGGGATAGGGGCAGGGATCGGGATAGAGATAGAAGGTATGATAACGAAAGA
GATCGTGAAAGGGACAGAGACAGGAGGCATGATTATGACAGAGACCGGGGAAGGGATAGAGACAG
GAGGTATGACTATGATCGAAGGTCAATTGAGAGAAGCAGAAGAGACTATGACAGGAGCAGGAGCC
GTAGTAGGAGTAGAAGCCACAGCCGAAGCTTGCATGATCAAGGTACAAGGCTTGACCAGCAGCGA

FIGURE 10 (continued)

ACTCCACCTAGGGATGAGAGCAAGGAGAAGAAGGCTGCATCTAGCAATCTGGCCAAGCTTAAAGA
TCTATATGGCGACTTCGGCAATAAAAAGGAGAACATAGGTGATGACAGGGCTCCAAATAGGGATA
CTAGTACTGAGGAGGTTATCAGACTTGGTGGTTCTACATGGAGGTAGTTGGTTACATTTACGTTT
TGTAAGAGTTTGGATACTCTCACTGTCTCACCTTCTCAGAAGAGCACATTGACAGCTAGCCTTTT
GTTGAAAGGGAATATGCAAACTGATAGCTGCAGAGAGGAGATGCTGTTTCATGTTTTCTGCAGTC
GGCAGAGCTGCTTGTAAACTGGATTTCCTTTACTATTATTTTAGACTTGTGTTACAATATTGGAT
GGATTTCAATTGTCCCTTTGTTTGTTAAAACATTATTACTACTTAAAGCAATTGACAAACTTATA
AGCC

SEQ ID NO: 95, protein - Lycopersicum esculentum
MAELKTSGRPIDQLLEKVLCMNILSSDYFRDLLRLKTYHEVIDEIYNQVDHVEPWMTGNCRGPST
AFCLLYKFFTMKLTVKQMHGLLKHPDSPYIRAIGFLYLRYLGDFKTLWGWYEPYLKDDEEFSPGS
SGQMTTMGVYVRDLFLGQYYFDTLLPRIPVPVVRTAVASLEKMNLPTKLSGSIGDSSRGSEETSR
RPPSVKASLSVSFGQRAPHRASTRDSSPIRRTIAPPSYDKDGANGSRRSPSMRRSQSRDLSDREN
SERDRGRDRDRDRDRDRDRDRERTRDRERDRDRDRDRYRDQERERDRGRDRDRDRRYDNERDRER
DRDRRHDYDRDRGRDRDRRYDYDRRSIERSRRDYDRSRSRSRSRSHSRSLHDQGTRLDQQRTPPR
DESKEKKAASSNLAKLKDLYGDFGNKKENIGDDRAPNRDTSTEEVIRLGGSTWR

SEQ ID NO: 96, DNA - Medicago truncatula
ATGGCAAATCGCACTGATCCAGCAGCGAAGAGTATTCGAGGCACAAACCCTCAAAACCTTGTTGA
AAAAATTCTCCGCTCAAAGATCTATCAGCACACTTATTGGAAAGAACAATGCTTCGGCTTAACAG
CAGAAACCCTAGTCGACAAAGCCATGGAGCTCGACCACCTCGGCGGAACTTACGGTGGCAACCGC
AAACCCACTCCCTTCATGTGCCTCGTCATGAAAATGCTTCAGATTCAACCCGAGAAAGAAATCGT
CATCGAATTCATCAAAAACGATGATTACAAGTATGTGAGGATACTGGGTGCATTTTATTTGCGTC
TTACTGGATCTGATACGGATGTGTACCATTATCTGGAGCCGTTGTATAATGATTATAGGAAACTG
CGGCGGAAATTACCGGATGGACAGTTTGCTTTGACACATGTTGATGAGGTTATTGATGAACTTCT
TACAACTGATTATTCCTGTGATATTGCTATGCCCCGTATTAAGAAAAGGTGGACTCTTGAATCTC
TTGGTGCCTTAGAACCTAGACAAAGTGCACTTGAAGAGGATTTTGAGGAGGAAGAGGAAAATGAG
GATAATGAACAGCCTGCTGAGGAGCCTGAGAAGGATTATAATCGTGGGCGAAGCCCTGCAAGGGA
AAGAGATAGGGATAGAAGACGTGATAGTCATAGACACAGGGATCGTGACTATGACAGAGAATATG
ATAGAGATTATGACAGAGAGCGAGGACGTGGCCGAGATAGAGATCGGGACAGAGATAGGGAAAAG
GAAAGGGACAGAGATAGGGAGAGGGACAGAGACCGATATCGTCTGAGGGAAGAAAAGGATTATGG
TCGTGAGAGAGAAGGTAGGGAGCGCGAGAGGAGAGACAGAGATCGTGACCGTGGTAGGAGGAGGA
GCTACTCAAGGAGTCGAAGTAGAAGCAGGGATCGCAAGGATCATGATGGTGGGGACTACAGAAAG
AGACATGCTCGAAGTAGCGTAAGTCCAAGAAGAGATGGAGCTGAGGATGGTGAGCCAAAGAAGAA
GAAGGAAAAGAAAGAAAAGAAGGAAAAGAAGGATGACGGGACCGACCATCCAGATCCAGAGATTG
CAGAAGCAAACAGGATACGAGCATCACTGGGTTTGAAACCACTTAAGATGTG

SEQ ID NO: 97, protein - Medicago truncatula
MANRTDPAAKSIRGTNPQNLVEKILRSKIYQHTYWKEQCFGLTAETLVDKAMELDHLGGTYGGNR
KPTPFMCLVMKMLQIQPEKEIVIEFIKNDDYKYVRILGAFYLRLTGSDTDVYHYLEPLYNDYRKL
RRKLPDGQFALTHVDEVIDELLTTDYSCDIAMPRIKKRWTLESLGALEPRQSALEEDFEEEENE
DNEQPAEEPEKDYNRGRSPARERDRDRRRDSHRHRDRDYDREYDRDYDRERGRGRDRDRDRDREK
ERDRDRERDRDRYRLREEKDYGREREGRERERRDRDRDRGRRRSYSRSRSRSRDRKDHDGGDYRK
RHARSSVSPRRDGAEDGEPKKKKEKKEKKEKKDDGTDHPDPEIAEANRIRASLGLKPLKM FIGURE 10 (continued)

SEQ ID NO: 98, DNA - Oryza sativa
ATGGAGATACAAACTTCAGGGAAGCCCATTGATCTGCTGATGGAGAAGGTTCTTTGTATGAACAT
TATGTCTTCTGATTACTTCAAGGAGCTCTACAGGCTGAAGACCTATCATGAGGTCATTGATGAAA
TATACAATCAAGTTGATCATGTGGAGCCTTGGATGACTGGCAATTGCAGGGGCCCCTCCACTGCA
TTCTGTCTCCTCTACAAGTTCTTCACCATGAAGCTTACTGTCAAACAGATGCATGGTTTGTTGAA
GCATCCTGATTCCCCATACATTAGAGCTATAGGGTTCTTGTATCTTCGATATGTTGCAGATCCGA
AGATCTTGTGGACGTGGTATGAGCCCTACTTGAAGGATGATGAGGAATTCTCCCCTGGATCTAAT
GGTCGCATGACAACCATGGGTGTTTATGTGCGTGATCTTATACTTGGACAGTACTACTTCGATAG
TCTTCTTCCAAGAGTTCCTCTTCCAGTAATTCGTCAAGTGACATCCAATCTTGAGAAGATGAAGT
TGCCCACTAAGCTTTCTGGGATTACTGGAGAGTCTAATCGTCATGGATCAGAAGATACTGCCCGC
CGGCCTCCTTCCGTGAAGGCTTCTCTGTCAGTTTCCTTTGGACAGCGTGCTCCGCATCGTGCATC
CACACGGGAGTCATCTCCAGTTCGGAGGACAGTCACCCATGATGGCCATCGTAAATCTTCCTCAC
CATCTCGCCGTAGCGGAAGCCGCGAGGTTCCTGATCGTGATCGATCAAGCCGTGACCGTTCTAGT
CGTGACTATGACCGTTCAAGCCATGACCGTGATCGTGACCATTCCAGTCGTGACTATGACCGTCC
AAGCCATGACCGTGACCGTGATCGTGACCGTTCCAGTCGTGACTATGACCGTTCAAGTCGTGACC
GGGATCATGATAGAGACATCAGAGACTATCATCGGCGTGATCGTGACAGCAGGGACCGTGACTAT
AGGTCTAGGCATTCATCCGAAAGACAAGATGACCGAAGGGACCGTGACCGTGAGGGTAGCAGGCA
CAGACGGTCCAGCTCTCGGCACAGAAGCAGAAGCCGCAGCCGCAGCCGCAGCCGCAGCAGAAGCA
GGAGCCGCAGCAGAAATGAGGAGAGATCCAGTCCTTTTGGCAATGCAGGCAAAGAAAAGACTGCT
GCCATCTCGAGCAACCTAGCAAAGCTCAAGGACTTGTATGGTGATGTAACTGAGAAGAAGGACGA
CGGTGAAGCCCCTCGCCGTGATTCGTGCGCGGAGGAGGTTATCAGGTTGGGTGGCCCGAGATGGA
GATAG

SEQ ID NO: 99, protein - Oryza sativa
MEIQTSGKPIDLLMEKVLCMNIMSSDYFKELYRLKTYHEVIDEIYNQVDHVEPWMTGNCRGPSTA
FCLLYKFFTMKLTVKQMHGLLKHPDSPYIRAIGFLYLRYVADPKILWTWYEPYLKDDEEFSPGSN
GRMTTMGVYVRDLILGQYYFDSLLPRVPLPVIRQVTSNLEKMKLPTKLSGITGESNRHGSEDTAR
RPPSVKASLSVSFGQRAPHRASTRESSPVRRTVTHDGHRKSSSPSRRSGSREVPDRDRSSRDRSS
RDYDRSSHDRDRDHSSRDYDRPSHDRDRDRDRSSRDYDRSSRDRDHDRDIRDYHRRDRDSRDRDY
RSRHSSERQDDRRDRDREGSRHRRSSSRHRSRSRSRSRSRSRSRSRSRNEERSSPFGNAGKEKTA
AISSNLAKLKDLYGDVTEKKDDGEAPRRDSCAEEVIRLGGPRWR

SEQ ID NO: 100, DNA - Oryza sativa
ATGGCGAACCGCACGGACCCCCTGGCGAAGAGCATCCACGGGACGAACCCTCAGAACCTGGTGGA
GAAGATCGTCCGGTCCAAGATCTACCAGAGCACCTACTGGAAGGAGCAGTGCTTTGGCCTCACCG
CCGAGACCCTCGTCGACAAGGCCATGGAGCTCGACCACACCGGCGGCACCTACGGCGGCAACCGC
AAGCCCACCCCCTTCCTCTGCCTCGCCCTCAAGATGCTCCAGATCCAGCCCGACAAGGACATCGT
CGTCGAGTTCATCAAGAACGAGGATTACAAGTATGTCCGTGTTCTTGGTGCCTTCTACCTTCGCC
TCACTGCCACCGTCGCCGACGTCTACCAATACCTCGAGCCGCTCTACAACGACTACCGCAAGATC
AGGCACAAGCTCAGTGATGGAAAGTTTACCCTGACCCACGTCGACGAGTTCATTGACGACCTCCT
CACCAAGGACTACTCCTGCGATACGGCCCTCCCCCGCATCCAGAAAGATGGGTTCTTGAAACTT
CTGGAACTCTAGAACCAAGAAGAAGTGCACTTGAAGATGATTTTGAGGAAGAGGAGGAAGACAAG
GAGGATGAACAACCTATGGATATAGATGAGCCAAATGGTCGTGAAAGCATGATCATTATCGTGG

```
AAGGAGCCCTACTAGAGATCGAGACAGGGAGAGGAAACATGAAAGACACCACAGGGACCGAGATT
ACGACAGAGATCGGGATTATGGTAGGGGACGGGAAAGAGACCGAGATAGAGACCGTGAAAGAGAT
AGAGACAGGGATAGAGATCGGGATCGGGATCGGGATCGAGACCGTCATCGCATACGAGATGAGGA
CTACAGTCGAGATAGGGACCGAGCAAGAGATAGGGATGGCAGGGAAAGAGAACGCTGGGACAGAG
ACCGTGGGAGGCGCAGGAGCCGTTCAAGGAGCAGGAGCAGGGATCGACGAGAAAGAGACCGAGAA
GATGGAGAGTACCGTAGGAGGCGTGATCGGGGTAGTGCCAGTCCTCGAGGTCATGCGGAGGATGG
TGGCTCAAGAGATGAGCCGAAGAAGAGAAAGGAAAAGAAAGAGAAGAAGGGTGAAGGAAATGCAC
CAGATCCAAATGACCCAGAGATTATAGAAATGAACAAGCTCCGAGCCTCTCTAGGGTTGAAACCA
CTGAAGTAG
```

SEQ ID NO: 101, protein - Oryza sativa
```
MANRTDPLAKSIHGTNPQNLVEKIVRSKIYQSTYWKEQCFGLTAETLVDKAMELDHTGGTYGGNR
KPTPFLCLALKMLQIQPDKDIVVEFIKNEDYKYVRVLGAFYLRLTATVADVYQYLEPLYNDYRKI
RHKLSDGKFTLTHVDEFIDDLLTKDYSCDTALPRIQKRWVLETSGTLEPRRSALEDDFEEEEEDK
EDEQPMDIDEPNGREKHDHYRGRSPTRDRDRERKHERHHRDRDYDRDRDYGRGRERDRDRDRERD
RDRDRDRDRDRDRHRIRDEDYSRDRDRARDRDGRERERWDRDRGRRRSRSRSRSRDRRERDRE
DGEYRRRRDRGSASPRGHAEDGGSRDEPKKRKEKKEKKGEGNAPDPNDPEIIEMNKLRASLGLKP
LK
```

SEQ ID NO: 102, DNA - Ostreococcus tauri
```
ATGACGTACTGGAAGGAGAAGTGCTTCGGCGTGAGCGCCGAGGCGTTGGTCGATCTCGCGGTCGA
CCTCAGGTCGGTGGGTGGGATTTACGGCGGGAACAACAGAGCGACGGAGTTTTTGTGCCTCACGC
TGAAGCTGTTGCAGATACAGCCTGAGAAGGAGATCGTGTTAGAGTTTATTAAGAATGAGGATCAC
AAGTACGTCAGGTTGCTCGGCGCGTTTTACCTACGGTTGGTGGGGAAACCGACGGACGTGTACAG
ATACCTCGAGCCGCTGTTAACGACTATAGAAAGGTTCGGTATCGCACGCGTGATGGGAAGTACG
CACTGACGCATGTGGATGAGTTTGTGAACAATTTGTTGACGAAGGATATGTTTTGCGACGTGACG
CTCCCACGCGTGCCGCATCGCCAGGTGTTAGAGGCCGCGGGAGCGCTTGAGCCACGCGTATCTGC
GCTTGAGGAGGATATCGCAGATTTGGAGGAAGAGCTCGAGAGCGCGGTGGAGGAGGCAATAGGTC
AACGGATGAACATGGATGTCGACGCAGGCGAGGCCGCTGCCGCGGCGTCCACTCGAGGTGCGCGC
GAGGACGGCGAGATCGTTGCGTCGGGATCGAAGCGTTCGCGCGAGCACGATGGCGTTCGGTATCG
AGAATGTGACGATAGCGACGGTGACAGGTACGTCCGAAGGCGCGAGCGGTCGAGATCTAGGAGTC
GCGACCGCGTGCCGGCACGCCGCGACGACGCTCGGCCCGGAGTTTTGGCTAGTGGCGAAGAGATG
GATCACAGAGAGAAGAAGGAGAAGAAAGAGAAGAAGGAAAAACGAGAGAAGAAGGAGAAGACCGA
GATGGACCCCGAAATCGCAGAGGCGAATGCGATCAGGGCCAAGCTCGGGTTGAAGCCGCTTCGTG
GATGA
```

SEQ ID NO: 103, protein - Ostreococcus tauri
```
MTYWKEKCFGVSAEALVDLAVDLRSVGGIYGGNNRATEFLCLTLKLLQIQPEKEIVLEFIKNEDH
KYVRLLGAFYLRLVGKPTDVYRYLEPLLNDYRKVRYRTRDGKYALTHVDEFVNNLLTKDMFCDVT
LPRVPHRQVLEAAGALEPRVSALEEDIADLEEELESAVEEAIGQRMNMDVDAGEAAAAASTRGAR
EDGEIVASGSKRSREHDGVRYRECDDSDGDRYVRRRERSRSRSRDRVPARRDDARPGVLASGEEM
DHREKKEKKEKKEKREKKEKTEMDPEIAEANAIRAKLGLKPLRG
```

FIGURE 10 (continued)

SEQ ID NO: 104, DNA - Ostreococcus tauri
ATGCCGTCGGTGATCGAAAACCACGGACGACCGATCTGGACCCCGTTCGGGAACGGCGCGGCGAC
GAGCGGGAAGTCGCACGGCGTCGAGGAGGTGCTTCGACAAAACATTGCGCACTCAGAATACTTTC
GAAAACTTCGTCGCGCGGACGATCTGGGCGACCGGCGTACGATTTCATGGCGCTCGTGGATGAG
ATTTATGAATTGGTCGATCACTGCGAACCGTGGATGTGCGGGAACGCGCGGGGGCGTCGACGGG
GTTTTGCATCTTGTTTCAATTCTGTGAGATGGAGCTCAGCGACGGCAACGTGTGGCATTTGTTGA
GGCACGGAGACTCGCCGTTTATCCGAGCTTTAGGGTTCCTGTATGTACGGTACGTGAAGAACGGG
CGGGAGCTCTTGAAGTGGTGCGAGGAGTTCTTCGGAGACGAGGAAAAGTTTAAACCGTCGCCGGA
CGGGAAGGAGGTGACGATGGGCGCGTTCGTTCGCGACTTGCTGCTCGAGCAGAGGTACTTCGAAA
CCATCCTGCCGAGGATTCCTGAGGTTGCGAGGAGAGAGATCATAAAGGTCTCGGTTGCGGTGGTC
AGGGCGGGAGCCGCATTGCTGGTGGTTCTCAGCCGCAGTCTGTGA

SEQ ID NO: 105, protein - Ostreococcus tauri
MPSVIENHGRPIWTPFGNGAATSGKSHGVEEVLRQNIAHSEYFRKLRRADDLGRPAYDFMALVDE
IYELVDHCEPWMCGNARGASTGFCILFQFCEMELSDGNVWHLLRHGDSPFIRALGFLYVRYVKNG
RELLKWCEEFFGDEEKFKPSPDGKEVTMGAFVRDLLLEQRYFETILPRIPEVARREIIKVSVAVV
RAGAALLVVLSRSL

SEQ ID NO: 106, DNA - Populus trichocarpa
CTCAGGAGTGCTTGGATTGTTTAGTACAGTATGGAGATACAGACAAATGGGAAACCAATAGATTC
GCTGTTAGAGAAGGTCCTTTGTATGAACATACTATCATCAGATTACTTCAAGGAGCTTTACCGAT
TAAAGACATACCATGAAGTGATAGATGAAATATACAATCAAGTTGACCATGTTGAGCCATGGATG
ACTGGCAACTGTCGTGGTCCATCTACTTCCTTTTGCCTTCTATACAAGTTCTTCACCATGAAACT
CACTGTCAAACAAATGCATGGTTTGCTAAAGCACAAGGATTCTCCTTATATCAGAGCGGTTGGGT
TCCTCTACCTGAGATATGCTGGGGATCCAAAGACACTGTGGAATTGGTTTGAACCATATATTAAA
GACGATGAGGAATTTTCTCCAGGAACTAGTGGAAGGAAGACGACAATGGGTGTTTATGTGCGTGA
TTTGCTTCTCGGACAGTACTACTTTGATACCCTTTTCCCCCGTATTCCTGTTCCTGTCATGCGGC
AGATCACATCGAATCTGGAGAAGTTGAAGCTACCAACAAAAATCTCTGGTTCGACAGGGGATGGA
AACCGTCATGGATCTGATGATACGGCACGCCGGCCACCATCTGTGAAGGCAGCACTTTCAGTCTC
TTTTGGTCAGCGTGCTCCTCATCGTGCATCAACCAGGGATTCGTCTCCTGTTCGTCGCACAATAC
CTTCCCCCTCCTATGACAGAACCAGTGATGATTCACGAAGTCGACTCGGCCAGAGTCGTGAATAT
TCTGATAAAGAATATTCAGATCGGGATCATGATAGGGGTAGGGAAAGGGACCAAGACCATGATCG
GGATAGAGAGAGGGACAGGGTTCGGGATAGGGATCAGGAGAGAGAAAGGGACCGGGATCGTGAAA
GGGATTGGGATCAGAGTCGGGACAGAGACAGGGATCGGGAAAGGGATAGATACAGAAGGTATGAT
TATGATAGAAGTTCCAGGTACACTGATAGGGAAAGCAGAAGGGATTCTGAACAGAGCAGCCGTGA
CAGAAGTAGGCATTATAGAGAAAGTAGTTCTTATAGAAGCCGCAGTCGAAGCAGGAGCAGGAGCA
GGAGCCGAAGCTCGCAAGCTGGCGCATCACCATTTGATCGCCATCCAACTCCTCAAAGGGATGGA
AACAAGGATAAGACATCTGCGCCTAGCAATCTGGCTAAGCTCAAAGATCTTTATGGTGATCTTAG
TGATCAGAAAGGGGATGCTGGCCTGGAAAGGGTTCCTCGGAGGGATAATGATGGTGAAGAGGTTT
TTAGACTCGGTGGTTCCACTTGGAGGTAGGTAGTTCAATCTTAAAACAGTAGCTTCAGTGGCTGT
CACATCAGCTGTATCAATGAGGTCTTCAGCCAGGCCAAATTTCT FIGURE 10 (continued)

SEQ ID NO: 107, protein - Populus trichocarpa
MEIQTNGKPIDSLLEKVLCMNILSSDYFKELYRLKTYHEVIDEIYNQVDHVEPWMTGNCRGPSTS
FCLLYKFFTMKLTVKQMHGLLKHKDSPYIRAVGFLYLRYAGDPKTLWNWFEPYIKDDEEFSPGTS
GRKTTMGVYVRDLLLGQYYFDTLFPRIPVPVMRQITSNLEKLKLPTKISGSTGDGNRHGSDDTAR
RPPSVKAALSVSFGQRAPHRASTRDSSPVRRTIPSPSYDRTSDDSRSRLGQSREYSDKEYSDRDH
DRGRERDQDHDRDRERDRVRDRDQERERDRDRERDWDQSRDRDRDRERDRYRRYDYDRSSRYTDR
ESRRDSEQSSRDRSRHYRESSSYRSRSRSRSRSRSRSSQAGASPFDRHPTPQRDGNKDKTSAPSN
LAKLKDLYGDLSDQKGDAGLERVPRRDNDGEEVFRLGGSTWR

SEQ ID NO: 108, DNA - Populus trichocarpa
ACAGGAGTGCTTGCATTTGTTTAGTACATTATGGAGGTACAGACAAATGGGAAACCGATAGATTC
ACTCTTTGAGAAGGTCCTTTGTATGAACATTCTATCATCGGATTACTTCAAGGAGCTTTACCGAT
TAAAGACGTACCATGAAGTGATTGATGAAATATACAATCAAGTTGACAATGTTGAGCCATGGATG
ACTGGTAACTGTCGTGGCCCATCTACGTCCTTTTGCCTTCTGTACAAGTTCTTCACCATGAAGCT
CACTGTCAAACAAATGCATGGTCTGCTAAAGCACAAGGATTCTCCTTATATCAGAGCGGTTGGGT
TCCTTTACCTGAGATATGCTGGTGACCCAAAGACACTGTGGAATTGGTTTGAACCATATATCAAA
GATGATGAGGAATTTTCTCCTGGATCTAGTGGAAGGAAGACAACAATAGGCATATATGTGCGTGA
TTTACTTCTCGGACAGTACTACTTTGATACCCTTTTCCCCCGTATTCCTGTTCCTGTCTTGCGGC
AGATCACAGCCAATCTTGAGATGATGAAGCTACCCACAAAAATTTCTGGTTCAACAGGGGATGGC
AACCGTCATGGATCTGATGATACTGCACGTCGACCACCATCTGTGAAGGCTGCACTTTCAGTCTC
TTTTGGTCAGCGTGCTCCTCATCGTGCATCAACTAGGGACTCATCTCCTGTTCGTCGCACGCTAC
CGCCACCCTCCTATGACAGAACCAGTGATGATCCACGAAGTCATCGCAGCCAGAGTCGCGAATAT
TCTGATAAAGAATATTCAGACAGGGATCGGGATCAAGATAGGGGTAGAGAGAGGGACCGTGATAG
GGACAGAGAGAGGGACAGGGTTCGGGATAGAGATCATGATAGAGAAAGAGATCGGGACCGTGGCA
GGGACAGTGACAGGAAACAGGAACGTGAGAGGGGTAGAGACCGAAGGTCTGATTACGATAGGAGT
TCCAGGTACACTGACAGGGAGAGCAGAAGGGATTATGAACGGAGCAGCCGTGATGGAAGTAGGCG
TCATAGAGAAAGTAATTATAGAACCCGGAGTCGGAGCAGGAGCAGAAGTAGAAGCCAAAGCTTGC
AAGCTGGCACATCACCATTTGATCAGCATCCAACTCCTCAAAGGGATGGAAGCAAGGATAGGACA
TCTGCATCTAGCAATCTGGCTAAGCTCAAAGATCTTTATGGTGATCTTGGTGATCAGAAAGGGGA
TGCTGGCCTGGAAAGGGGTCCTCGGAGGGACAATGATGGTGAAGAAGTTTTTAGACTGGGTGGTT
CTACTTGGAGGTAGGTAGTTCAATGAAAGCTGTAACTGTCTGATGTATCAGTAAGGTCTTCAGCC
ATGCCAAATCACTGTTTGAGTCAAGAAAA

SEQ ID NO: 109, protein - Populus trichocarpa
MEVQTNGKPIDSLFEKVLCMNILSSDYFKELYRLKTYHEVIDEIYNQVDNVEPWMTGNCRGPSTS
FCLLYKFFTMKLTVKQMHGLLKHKDSPYIRAVGFLYLRYAGDPKTLWNWFEPYIKDDEEFSPGSS
GRKTTIGIYVRDLLLGQYYFDTLFPRIPVPVLRQITANLEMMKLPTKISGSTGDGNRHGSDDTAR
RPPSVKAALSVSFGQRAPHRASTRDSSPVRRTLPPPSYDRTSDDPRSHRSQSREYSDKEYSDRDR
DQDRGRERDRDRDRERDRVRDRDHDRERDRDRGRDSDRKQERERGRDRRSDYDRSSRYTDRESRR
DYERSSRDGSRRHRESNYRTRSRSRSRSRSQSLQAGTSPFDQHPTPQRDGSKDRTSASSNLAKLK
DLYGDLGDQKGDAGLERGPRRDNDGEEVFRLGGSTWR

FIGURE 10 (continued)

SEQ ID NO: 110, DNA - Saccharum officinarum
CGGGCTCCTTTCCTCCGCCTCTCGTCTAGTCCCTCTCCTACCGAACCCTCCCAATCCAAAGCGAT
TCCTCCGGGCCGCCGCCGTCCCGATCGCGCCGCGCCGCCGGGGCGGCGTCTCCCCGGCTGCCCTT
AGCTCAGCTCGCGTTCCGGTGGAACAGAGAAGAGAGGTGGGGGGAATGGAGATCCAGTCGTCTGG
CCGGCCCATCGAGGGGCTGATGGAGAAGGTGCTGTCCGTGAACATCCTCTCCTCGGACTACTTCA
AGGAGCTCTTCAAGTACAAGACCTACCACGAGGTGGTCGACGAGATCTACAACCAGGTGGACCAC
GTCGAGCCCTGGATGACCGGCAACTGCCGCGGGCCCTCCTCCGCCTTCTGCCTCCTCTACAAGTT
CTTCACCATGAAGCTCACCGTCAAGCAGATGCACGGGCTGCTCAAGCACCAGGACTCCCCCTACA
TCAGAGCTATTGGATTCCTCTACCTGCGATATGTTGCAGAACCGAAGACGCTGTGGACTTGGTAT
GAACCCTATATCAAGGATGACGAGGAGTTTGCCCCTGGATCAAATGGTAAAATGACTACAATGGG
CGTTTATGTGCGTGATCTCCTCCTTGGTCAGTACTATTTCGACAGTCTTCTTCCACGAGTGCCTC
TCCCAATTCTCCGACAGGTCACTAGCCATCTTGAGAAGCTGAAGCTTCCAACAAAGCAGTCAGGA
ATGACTGGGGATTCCAATAGGCTTGAATCAAATGATACTGCCAGAAGGCCTCCTTCCGTAAAGGC
TTCTTTGTCTGTCTCTTTTGGTCAGCGTGCTCCACACCGTGCATACACAAGGGATTCTTCCCCAG
TCCGAAGAACATTACCTTCCAAACAGGACAAGGAAAGAAGTTATGATGGTGACCATGCAAAATCG
CCACCAAGGAAGCGCAGAAGTCAGAGCTCTGAGCGCCATCATGACTCAGAGAGGGACCGTTCAAA
TCGTGATCGTGGCAAGTACAAGGATAGGGAGCATGATCGTTATGCTCGTGATCACAGAGACCGGG
ATCATCATCGGCAGAGTTATTCAGATAGGGATGACGAAAGGCGAGGCCGTGAAAAGAGGGACAGG
GATTCTGACCGAAAGAGATATTCAAGCTCCCGCANNGAGCAGGAGTCCAGTCCGTGGCAGAACTG
ACGGCGACAAACATCGCTCCAGCCCAATTTGTAGGGCACCAGAATCATTNCACCTGGCAAAGCTA
AAGGATTTATACGGTGATGCAACAAACACAAAGAATGATGCTTGCG

SEQ ID NO: 111, protein - Saccharum officinarum
MEIQSSGRPIEGLMEKVLSVNILSSDYFKELFKYKTYHEVVDEIYNQVDHVEPWMTGNCRGPSSA
FCLLYKFFTMKLTVKQMHGLLKHQDSPYIRAIGFLYLRYVAEPKTLWTWYEPYIKDDEEFAPGSN
GKMTTMGVYVRDLLLGQYYFDSLLPRVPLPILRQVTSHLEKLKLPTKQSGMTGDSNRLESNDTAR
RPPSVKASLSVSFGQRAPHRAYTRDSSPVRRTLPSKQDKERSYDGDHAKSPPRKRRSQSSERHHD
SERDRSNRDRGKYKDREHDRYARDHRDRDHHRQSYSDRDDERRGREKRDRDSDRKRYSSSRXEQE
SSPWQN

SEQ ID NO: 112, DNA - Saccharum officinarum
ATGGAGATCCAGTCATCTGCCCGGCCCATCGAGGGGCTGATGGAGAAGGTGCTGTCCGTGAACAT
CCTCTCCTCGGACTACTTCAAGGAGCTCTTCAAGTACAAGACCTACCACGAGGTGGTCGACGAGA
TCTACAACCAGGTGGACCACGTCGAGCCCTGGATGACCGGCAACTGCCGCGGGCCCTCCTCCGCC
TTCTGCCTCCTCTACAAGTTCTTCACCATGAAGCTCACCGTCAAGCAGATGCACGGGCTGCTCAA
GCATCAGGACTCCCCCTACATCAGAGCTATTGGATTCCTCTACCTGCGATATGTTGCAGAACCGA
AGACGCTGTGGACTTGGTATGAACCCTATATCAAGGATGACGAGGAGTTTGCCCCTGGATCAAAT
GGTAAATTGACTACAATGGGCGTTTATGTGCGTGATCTCCTCCTTGGTCAGTACTATTTCGACAG
TCTTCTTCCACGAGTGCCTCTCCCAATTCTCCGACAGGTCACTAGCCATCTTGAAGCTGAAGC
TTCCAACAAAGCAGTCAGGAATGACTGGGGATTCCAATAGGCTTGAATCAAATGATACTGCCAGA
AGGCCTCCTTCCGTAAAGGCTTCTTTGTCTGTCTCTTTTGGTCAGCGTGCTCCACACCGTGCATC
CACAAGGGATTCTTCCCCAGTCCGAAGAACATTACCTTCCAAACAGGACAAAGAAGAAGTTATG
ATGGTGACCATGCAAAATCGCCACCAAGGAAGCGCAGAAGTCAGAGCTCTGAGCGTCATCATGAC

FIGURE 10 (continued)

```
TCTGAGAGGGACCGTTCAGATCGTGATCGTGGCAGGTACAAGGGTAGGGAGCATGATCGTTATGC
TCGTGATCACAGAGACCGGGATCATCATCGGCAGAGTTATTCAGATAGGGATGACGAAAGGCGAG
GCCGTGAAAAGAGGGACAGGGATTCTGACCACAATAGACATTCAAGCTCCCGCAGGAGCAGGAGC
AGGAGTCCAGTCCGTGGCAGAACTGACGGTGACAAGCATCGCTCCAGCCCATTTGGTAGGGCACC
AGAATCATCCAACCTGGCAAAGCTAAAGGATTTATACGGTGATGCAACAAACACAAAGAATGATG
CTGGCGATGATAGAGCTCACAGGGATTCTGGAACGGAAGAGGTAATCCGACTGGGAGGGGCAAGG
TGGAGGTGA
```

SEQ ID NO: 113, protein - Saccharum officinarum
```
MEIQSSARPIEGLMEKVLSVNILSSDYFKELFKYKTYHEVVDEIYNQVDHVEPWMTGNCRGPSSA
FCLLYKFFTMKLTVKQMHGLLKHQDSPYIRAIGFLYLRYVAEPKTLWTWYEPYIKDDEEFAPGSN
GKLTTMGVYVRDLLLGQYYFDSLLPRVPLPILRQVTSHLEKLKLPTKQSGMTGDSNRLESNDTAR
RPPSVKASLSVSFGQRAPHRASTRDSSPVRRTLPSKQDKERSYDGDHAKSPPRKRRSQSSERHHD
SERDRSDRDRGRYKGREHDRYARDHRDRDHHRQSYSDRDDERRGREKRDRDSDHNRHSSSRRSRS
RSPVRGRTDGDKHRSSPFGRAPESSNLAKLKDLYGDATNTKNDAGDDRAHRDSGTEEVIRLGGAR
WR
```

SEQ ID NO: 114, DNA - Saccharomyces cerevisiae
```
ATGGCTGTCAATGAATTTCAAGTGGAGTCTAACATCTCTCCAAAACAACTGAATAACCAGTCAGT
GTCACTTGTTATTCCTCGGTTGACAAGAGATAAAATTCATAATTCAATGTACTATAAAGTAAATC
TAAGCAACGAATCTTTGAGAGGCAATACAATGGTAGAGCTTTTGAAAGTTATGATTGGCGCATTT
GGTACCATAAAAGGTCAAAATGGTCATTTACACATGATGGTTCTCGGTGGCATTGAGTTTAAATG
CATCTTAATGAAGTTAATCGAAATCAGACCGAATTTCCAGCAGTTGAACTTCTTATTGAATGTAA
AAAATGAGAACGGTTTTGACTCGAAATATATTATTGCTTTGCTTCTGGTTTATGCGCGGTTACAG
TATTATTATTTGAATGGCAATAACAAAAACGATGATGATGAAAATGATTTGATAAAGTTATTTAA
AGTACAATTATACAAATATTCACAGCATTATTTCAAACTAAAAAGTTTCCCACTACAAGTAGACT
GCTTTGCTCACTCCTATAACGAAGAACTTTGTATAATACACATTGATGAATTAGTCGATTGGTTG
GCCACACAGGACCATATCTGGGGTATTCCATTAGGGAAATGTCAATGGAATAAAATATACAACTC
TGATGAAGAGAGTAGTTCTAGCGAAAGCGAAAGTAATGGTGACAGTGAAGATGACAACGACACCA
GCAGCGAATCATAG
```

SEQ ID NO: 115, protein - Saccharomyces cerevisiae
```
MAVNEFQVESNISPKQLNNQSVSLVIPRLTRDKIHNSMYYKVNLSNESLRGNTMVELLKVMIGAF
GTIKGQNGHLHMMVLGGIEFKCILMKLIEIRPNFQQLNFLLNVKNENGFDSKYIIALLLVYARLQ
YYYLNGNNKNDDDENDLIKLFKVQLYKYSQHYFKLKSFPLQVDCFAHSYNEELCIIHIDELVDWL
ATQDHIWGIPLGKCQWNKIYNSDEESSSSESESNGDSEDDNTSSES
```

SEQ ID NO: 116, DNA - Triticum aestivum
```
ATGGCGAACCGCACGGACCCCCGGGCCCGGAGCATCCACGGCACCAACCCTCAGAACCTGGTGGA
GAAGATCGTGCGGGCCAAGATCTACCAGAGCAACTACTGGAAGGAGCAGTGCTTCGGCCTCACGG
CGGAGACCCTCGTCGACAAGGCCATGGAGCTCGACTACACCGGCGGCACCCACGGCGGCAACCGC
AGGCCGACCCCCTTCCTCTGCCTCGCTCTCAAGATGCTCCAGATCCAGCCCGACAAGGAAATCGT
CGTCGAGTTCATCAAGGACGAGGACTACAAGTATGTCCGGGTTCTTGGGGCCTTCTACCTGCGCC
```

FIGURE 10 (continued)

```
TCACTGGCACCGTCGCCGACGTTTACCAGTACCTCGAGCCGCTCTACAACGACTACCGCAAGATT
AGGCAAAAGCTCAGCGATGGAAAATTCACGCTGACACACGTTGACGAATTCATTGACGAGCTCCT
GACCAAGGACTATAGCTGCGGCACTGCCCTCCCCCGCATTCAGAAAAGATGGATCCTTGAAGCTT
CTGGAACTCTAGAACCTAGAAGAAGTGCACTTGAAGACGATTTTGAGGAAGAGGAGGAAGATAAG
GAGGATGGACAGCCTATGGACGTAGATGAGCCTAACACTCATGAAAAGGACCATCTTCGTGGAAG
AAGCCCCACCAAAGAACGCGACAGGGAAAGGGAGAGGGACAGAGACAGGAAACACGAAAGGCATC
ACAGGGACCGAGATCATGACAGAGATCGGGATCACGACAGGGACTATGGAAGAGGCCGGGAAAGA
GATCGAGACAGAGATAGAGGCCGTGAAAGAGATAGAGAGAGGGATAGGGAACGAGACCGTCACCG
CATCCGAGATGACGACTACCACCGAGATCGAGACCGGGATGGCAGGGAAAGGGAACGCCGGGACA
GAGACCGTGGCAGGCACAGGAGCCGCTCAGGGAGCAGAAGCCGGGATCGGCGTGAAAGAGACCGT
GAAGTGGGAGAGCTCCGTAAGAGGCGTGGCCGTGGTAGTGCCAGTCCTCCTCGGGGCGTGCCGA
GGATGGTCCGAGGGAGGAGCCTAAGAAGAGAAAGGAAAAGAAAGAGAAGAAGGGCAGCGGGAACG
GTCCAGATCCTAATGATCCAGAGATTATAGAGATGAACAAGCTGCGTGCATCGATAGGGTTGGGA
CCACTGAAGTAG
```

SEQ ID NO: 117, protein - Triticum aestivum
MANRTDPRARSIHGTNPQNLVEKIVRAKIYQSNYWKEQCFGLTAETLVDKAMELDYTGGTHGGNR
RPTPFLCLALKMLQIQPDKEIVVEFIKDEDYKYVRVLGAFYLRLTGTVADVYQYLEPLYNDYRKI
RQKLSDGKFTLTHVDEFIDELLTKDYSCGTALPRIQKRWILEASGTLEPRRSALEDDFEEEEEDK
EDGQPMDVDEPNTHEKDHLRGRSPTKERDRERERDRDRKHERHHRDRDHDRDRDHDRDYGRGRER
DRDRDRGRERDRERDRERDRHRIRDDDYHRDRDRDGRERERRDRDRGRHRSRSGSRSRDRRERDR
EVGELRKRRGRGSASPPRGRAEDGPREEPKKRKEKKEKKGSGNGPDPNDPEIIEMNKLRASIGLG
PLK

SEQ ID NO: 118, DNA - Vitis vinifera
```
ATGGCGAACCGTACGGACCCAGCGGCGAAGAGCATACGAGGCACGAATCCGCAAAACTTGGTGGA
GAAGATTCTGAGGTCGAAGATTTACCAGAACACGTACTGGAAGGAGCAGTGCTTTGGATTGACCG
CGGAGACTCTGGTTGACAAGGCCATGGAGCTCGACCACCTCGGCGGCACCTTTGGTGGTAACCGC
AAGCCCACGCCCTTCATGTGCCTCGTCATGAAAATGCTCCAGATCCAGCCCGAGAAGGACATCGT
CGTCGAGTTCATAAAAAACGAAGAGTACAAATATGTCCGAATACTTGGTGCATTTTATTTGCGTC
TTACAGGGATAGATACTGATGTGTACCAATACCTAGAGCCTCTATACAATGACTATCGGAAATTG
AGGAGAAAATTATCTGATGGAAATTATTCTTTGACACACGTTGATGAGGTTATCGATGAACTTCT
GACAAAAGATTATTCCTGTGACGTTGCCTTGCCCCGTATCAAGAAAAGATGGACTCTTGAATCCC
TTGGTACACTGGAACCAAGAAGAAGTGCTTTGAAGATGATTTTGAGGAAGAGGAAGAAAAGAA
GAGGATGACCAACTCATGGATGAATTAGATGTTGGGCTCATGAAAAGGATTATTATCGTGGGCG
AAGCCCTGCAAGGGAGAGAGATAGGGATAGAAAGCGTGACAGTCACAGATATAGAGATCGAGATT
ATGATAGGGAACGTGGAAGAGGACGAGAAAGAGATCGGGAAAGGGAAAGGGACAGAGACAGCTAT
AGAGACAGGGAGAGGGAGAGGGACAGAGACAGGGACCGCTATCGTCTGAGAGATGATAAAGAATA
TGGTCGTGACAGGGAGAGGGAAAGGGAGAGGGAAGGCAGGGAGAGGGAGAGGCGAGACAGGGACC
GAGCCATTCAAGGAGCCGAAGTAGGAGCAAGGATCAGGCATGCTCGCAGCAGCACCAACATGCCA
GAGGATGGAACCACTCGAGAAGAGCCAAGGAAGAAGAAAGAAAAGAAGGAGAAGAAGGATGATGG
CACTGACCACCCAGATCCAGAGATTGCAGAAGCAAACAGGTTGCGGGCATCCCTTGGGCTTAAAC
CCTTGAAACTCTAA
```

FIGURE 10 (continued)

SEQ ID NO: 119, protein - Vitis vinifera
MANRTDPAAKSIRGTNPQNLVEKILRSKIYQNTYWKEQCFGLTAETLVDKAMELDHLGGTFGGNR
KPTPFMCLVMKMLQIQPEKDIVVEFIKNEEYKYVRILGAFYLRLTGIDTDVYQYLEPLYNDYRKL
RRKLSDGNYSLTHVDEVIDELLTKDYSCDVALPRIKKRWTLESLGTLEPRRSALEDDFEEEEEKE
EDDQLMDELDVGAHEKDYYRGRSPARERDRDRKRDSHRYRDRDYDRERGRGRERDRERERDRDSY
RDRERERDRDRDRYRLRDDKEYGRDREREREREGRERERRDRDRAIQGAEVGARIRHARSSTNMP
EDGTTREEPRKKKEKKEKKDDGTDHPDPEIAEANRLRASLGLKPLKL

SEQ ID NO: 120, protein - Artificial sequence - Motif Ib
RRPPSVKASLSVSFGQRAPHRASTRDSSPVRRT

SEQ ID NO: 121, protein - Artificial sequence - Motif IIb
SPYIRA(I/V)GFLYLRY

SEQ ID NO: 122, protein - Artificial sequence - Motif IIIb
KLKDLYGD

SEQ ID NO: 123, protein - Artificial sequence - Motif IVb
(L/N)XE(K/N)VL

SEQ ID NO: 124, protein - Artificial sequence - Motif Vb
LVEK(I/V)

SEQ ID NO: 125, DNA - Artificial sequence - primer 1
GGGGACAAGTTTGTACAAAAAAGCAGGCTTAAACAATGGCGGAGATACAGTCAAA

SEQ ID NO: 126, DNA - Artificial sequence - primer 2
GGGGACCACTTTGTACAAGAAAGCTGGGTTCACCTCCAAGAGGAACCA

SEQ ID NO: 127, DNA - Oryza sativa
AATCCGAAAAGTTTCTGCACCGTTTTCACCCCCTAACTAACAATATAGGGAACGTGTGCTAAATA
TAAAATGAGACCTTATATATGTAGCGCTGATAACTAGAACTATGCAAGAAAAACTCATCCACCTA
CTTTAGTGGCAATCGGGCTAAATAAAAAAGAGTCGCTACACTAGTTTCGTTTTCCTTAGTAATTA
AGTGGGAAAATGAAATCATTATTGCTTAGAATATACGTTCACATCTCTGTCATGAAGTTAAATTA
TTCGAGGTAGCCATAATTGTCATCAAACTCTTCTTGAATAAAAAATCTTTCTAGCTGAACTCAA
TGGGTAAAGAGAGAGATTTTTTTAAAAAAATAGAATGAAGATATTCTGAACGTATTGGCAAAGA
TTTAAACATATAATTATATAATTTTATAGTTTGTGCATTCGTCATATCGCACATCATTAAGGACA
TGTCTTACTCCATCCCAATTTTTATTTAGTAATTAAAGACAATTGACTTATTTTTATTATTTATC
TTTTTTCGATTAGATGCAAGGTACTTACGCACACACTTTGTGCTCATGTGCATGTGTGAGTGCAC
CTCCTCAATACACGTTCAACTAGCAACACATCTCTAATATCACTCGCCTATTTAATACATTTAGG
TAGCAATATCTGAATTCAAGCACTCCACCATCACCAGACCACTTTTAATAATATCTAAAATACAA
AAAATAATTTTACAGAATAGCATGAAAAGTATGAAACGAACTATTTAGGTTTTTCACATACAAAA
AAAAAAAGAATTTTGCTCGTGCGCGAGCGCCAATCTCCCATATTGGGCACACAGGCAACAACAGA

FIGURE 10 (continued)

```
GTGGCTGCCCACAGAACAACCCACAAAAAACGATGATCTAACGGAGGACAGCAAGTCCGCAACAA
CCTTTTAACAGCAGGCTTTGCGGCCAGGAGAGAGGAGGAGAGGCAAAGAAAACCAAGCATCCTCC
TTCTCCCATCTATAAATTCCTCCCCCCTTTTCCCCTCTCTATATAGGAGGCATCCAAGCCAAGAA
GAGGGAGAGCACCAAGGACACGCGACTAGCAGAAGCCGAGCGACCGCCTTCTCGATCCATATCTT
CCGGTCGAGTTCTTGGTCGATCTCTTCCCTCCTCCACCTCCTCCTCACAGGGTATGTGCCTCCCT
TCGGTTGTTCTTGGATTTATTGTTCTAGGTTGTGTAGTACGGGCGTTGATGTTAGGAAAGGGGAT
CTGTATCTGTGATGATTCCTGTTCTTGGATTTGGGATAGAGGGGTTCTTGATGTTGCATGTTATC
GGTTCGGTTTGATTAGTAGTATGGTTTTCAATCGTCTGGAGAGCTCTATGGAAATGAAATGGTTT
AGGGATCGGAATCTTGCGATTTTGTGAGTACCTTTTGTTTGAGGTAAAATCAGAGCACCGGTGAT
TTTGCTTGGTGTAATAAAGTACGGTTGTTTGGTCCTCGATTCTGGTAGTGATGCTTCTCGATTTG
ACGAAGCTATCCTTTGTTTATTCCCTATTGAACAAAAATAATCCAACTTTGAAGACGGTCCCGTT
GATGAGATTGAATGATTGATTCTTAAGCCTGTCCAAAATTTCGCAGCTGGCTTGTTTAGATACAG
TAGTCCCCATCACGAAATTCATGGAAACAGTTATAATCCTCAGGAACAGGGGATTCCCTGTTCTT
CCGATTTGCTTTAGTCCCAGAATTTTTTTTCCCAAATATCTTAAAAAGTCACTTTCTGGTTCAGT
TCAATGAATTGATTGCTACAAATAATGCTTTTATAGCGTTATCCTAGCTGTAGTTCAGTTAATAG
GTAATACCCCTATAGTTTAGTCAGGAGAAGAACTTATCCGATTTCTGATCTCCATTTTTAATTAT
ATGAAATGAACTGTAGCATAAGCAGTATTCATTTGGATTATTTTTTTATTAGCTCTCACCCCTT
CATTATTCTGAGCTGAAAGTCTGGCATGAACTGTCCTCAATTTTGTTTTCAAATTCACATCGATT
ATCTATGCATTATCCTCTTGTATCTACCTGTAGAAGTTTCTTTTTGGTTATTCCTTGACTGCTTG
ATTACAGAAAGAAATTTATGAAGCTGTAATCGGGATAGTTATACTGCTTGTTCTTATGATTCATT
TCCTTTGTGCAGTTCTTGGTGTAGCTTGCCACTTTCACCAGCAAAGTTC
```

FIGURE 10 (continued)

MSTIYMSQLPATLPLMEGDQDQGLYPAFHRAKDPPILFPFMIDSAVE

HQGQIYGDQGLRRQQVLGESNQQFNDHMMMGGSDVFLTPSPFRPTIQ

SIGSDMIQRSSYDPYDIESNNKQHANGSTSKWMSTPPMKMRIIRKGA

ATDPEGGAVRKPRRRAQAHQDESQQQLQQALGVVRVCSDCNTTKTPL
                                      $\underline{\phantom{CSDCNTTKTPL}}$
                                              1

WRSGPCGPKSLCNACGIRQRKARRAMAAAANGGAAVAPAKSVAAAPV
$\underline{\phantom{WRSGPCGPKSLCNACGIRQRKARRA}}$
     1                2

NNKPAAKKEKRAADVDRSLPFKKRCKMVDHVAAAVAATKPTAAGEVV

AAAPKDQDHVIVVGGENAAATSMPAQNPISKAAATAAAAAASPAFFH

GLPRDEITD<u>AAMLLMTLS</u>CGLVHS
          3

FIGURE 11

CLUSTAL W (1.83) multiple sequence alignment

```
GATAp      ------------------------------------------------
A2X2I3     ------------------------------------------------
A3A4M7     ------------------------------------------------
A3BCY3     ------------------------------------------------
A2YE96     ------------------------------------------------
Q5Z624     ------------------------------------------------
Q8LC59     ------------------------------------------------
AAB61058   MERSRSETPSSRSRLKLCFINSPPSSIFTGSKIEAEDGSPLVIELVDATTNTLVSTGPFS
ABK28715   ------------------------------------------------
AAM63829   ------------------------------------------------
Q1EBW4     ------------------------------------------------
AAL38250   ------------------------------------------------
CAB79470   ------------------------------------------------
CAN63090   ------------------------------------------------
CAO65359   ------------------------------------------------
A0JPW8     ------------------------------------------------
CAO44870   ------------------------------------------------
A5BCR3     ------------------------------------------------
A2XNM3     ------------------------------------------------
Q5JNB8     ------------------------------------------------
Q8LC79     ------------------------------------------------
```

FIGURE 12

```
GATAp       ----------------------------------------------------------------
A2X2I3      ----------------------------------------------------------------
A3A4M7      ----------------------------------------------------------------
A3BCY3      ----------------------------------------------------------------
A2YE96      ----------------------------------------------------------------
Q5Z624      ----------------------------------------------------------------
Q8LC59      ----------------------------------------------------------------
AAB61058    SSRVELVPLNADFTEESWTVEGFNRNILTQREGKRPLLTGDLTVMLKNGVGVITGDIAFS
ABK28715    ----------------------------------------------------------------
AAM63829    ----------------------------------------------------------------
Q1EBW4      ----------------------------------------------------------------
AAL38250    ----------------------------------------------------------------
CAB79470    ----------------------------------------------------------------
CAN63090    ----------------------------------------------------------------
CAO65359    ----------------------------------------------------------------
AOJPW8      ----------------------------------------------------------------
CAO44870    ----------------------------------------------------------------
A5BCR3      ----------------------------------------------------------------
A2XNM3      ----------------------------------------------------------------
Q5JNB8      ----------------------------------------------------------------
Q8LC79      ----------------------------------------------------------------
```

FIGURE 12 (continued)

| | |
|---|---|
| GATAp | |
| A2X2I3 | |
| A3A4M7 | |
| A3BCY3 | |
| A2YE96 | |
| Q5Z624 | |
| Q8LC59 | |
| AAB61058 | DNSSWTRSRKFRLGAKLTGDGAVEARSEAFGCRDQRGEWVSKKTWNTIVSHAMDCVLDET |
| ABK28715 | |
| AAM63829 | |
| Q1EBW4 | |
| AAL38250 | |
| CAB79470 | |
| CAN63090 | |
| CAO65359 | |
| A0JPW8 | |
| CAO44870 | |
| A5BCR3 | |
| A2XNM3 | |
| Q5JNB8 | |
| Q8LC79 | |

FIGURE 12 (continued)

| | | |
|---|---|---|
| GATAp | | |
| A2X2I3 | | ---MSTIYMSQLPATLPLMEGDQ------ |
| A3A4M7 | | ---MSTIYMSQLPATLPLMEGDQ------ |
| A3BCY3 | | ---MSTIYMSQLPATLPLMEGDQ------ |
| A2YE96 | | ------MEGEHHHHHQD |
| Q5Z624 | | ---------MEGEH---HQD |
| Q8LC59 | | ---MSTIYMSQLSAALPLMEGEHHHHHQD |
| AAB61058 | ECYIYNANTPGVTLLFNSVYELIRVSFNGNDIQNLDQPILDQLKAEAYQNLNRITAVNDR | |
| ABK28715 | | |
| AAM63829 | | |
| Q1EBW4 | | ---MDSNFHYSIDLNEDQNHHEQPFFYPLGSSSSLHHHHHHHHQVP |
| AAL38250 | | ---MDSNFHYSIDLNEDQNHHEQPFFYPLGSSSSLHHHHHHHHQVP |
| CAB79470 | | ---MGSNFHYTIDLNEDQNH--QPFFASLG--SSLHHHLQQQQQQQQ |
| CAN63090 | | |
| CAO65359 | | |
| A0JPW8 | | |
| CAO44870 | | |
| A5BCR3 | | |
| A2XNM3 | | |
| Q5JNB8 | | |
| Q8LC79 | | ------MMQTPYTTSTQGQYCHSCGMF |

FIGURE 12 (continued)

```
GATAp      -DQGLYPAFHR-AKDPPILFP---------------------------------------------------FMID------SAVEHQGQIY
A2X2I3     -DQGLYPAFHR-AKDPPILFP---------------------------------------------------FMID------SAVEHQGQIY
A3A4M7     -DQGLYPAFHR-AKDPPILFP---------------------------------------------------FMID------SAVEHQGQIY
A3BCY3     HHQGHFQAFSLQPKDPPVLFP---------------------------------------------------FVISRRSSSSSPSDSTTLSY
A2YE96     HHQGHFQAFSLQPKDPPVLFP---------------------------------------------------FVINRRSSSSSPSDSTTLSY
Q5Z624     HHQGHFQAFSLQPKDPPVLFP---------------------------------------------------FVISRRSSSSSPSDSTTLSY
Q8LC59     ----------------------------------------------------------------------------------------------
AAB61058   TFVGHPQRSLQCPQDPGFVVTCSGSQHIDFQGSLDPSSSSMALCHKASSSTVHPDVLMSF----------------------------------
ABK28715   ----------------------------------------------------------------------------------------------
AAM63829   ----------------------------------------------------------------------------------------------
Q1EBW4     SNSSSSSSSISSLSS-----YLPFLINSQEDQ-HVAYNNTYHADHL--HLSQPLKAKMFVA---------------------------------
AAL38250   SNSSSSSSSISSLSS-----YLPFLINSQEDQ-HVAYNNTYHADHL--HLSQPLKAKMFVA---------------------------------
CAB79470   HFHHQASSNPSSLMSPSLSYFPFLINSRQDQVYVGYNNTFHDVLDTHISQPLETKNFVS-----------------------------------
CAN63090   ----------------------------------------------------------------------------------------------
CAO65359   ----------------------------------------------------------------------------------------------
A0JPW8     ----------------------------------------------------------------------------------------------
CAO44870   ----------------------------------------------------------------------------------------------
A5BCR3     ----------------------------------------------------------------------------------------------
A2XNM3     ----------------------------------------------------------------------------------------------
Q5JNB8     ----------------------MVFSMQNGGVFEQNGEDYHH---------------------------------------------------
Q8LC79     HHHSQSCCYNNNNNSNAGSYS-------------------------------------------------------------------------
```

FIGURE 12 (continued)

```
GATAp      GDQGLRRQQVLGESNQQFNDHMMGGSDVFLTPSPFRPTIQSIGSDMIQRSSYDPYDIES
A2X2I3     GDQGLRRQQVLGESNQQFNDHMMGGSDVFLTPSPFRPTIQSIGSDMIQRSSYDPYDIES
A3A4M7     GDQGLRRQQVLGESNQQFNDHMMGGSDVFLTPSPFRPTIQSIGSDMIQRSSYDPYDIES
A3BCY3     GSDHHLTQQQQHQHQAMLEPQNMIGGSSAGIFATPF-PTVKSIRDDMIERSQFDPYDTEK
A2YE96     GSDHHLTQQQQHQHQAMLEPQNMIGGSSAGIFATPF-PTVKSIRDDMIERSQFDPYDTEK
Q5Z624     GSDHHLTQQQQHQHQAMLEPQNMIGGSSAGIFATPF-PTVKSIRDDMIERSQFDPYDTEK
Q8LC59     ------------------------------------------------------------
AAB61058   DNSSTARFHIDKKFLPTEGNSFKVSELDQVHGKSQTVVTKGCIENNEEDENAFSYHHHDD
ABK28715   ------------------------------------------------------------
AAM63829   ------------------------------------------------------------
Q1EBW4     NGGSSACDHMVPKKETRLKLTIRKKDHEDQPHPLHQNPTK--PDSDSDKWLMSPKMRLIK
AAL38250   NGGSSACDHMVPKKETRLKLTIRKKDHEDQPHPLHQNPTK--PDSDSDKWLMSPKMRLIK
CAB79470   DGGSSSSDQMVPKKETRLKLTIRKKDNHQDTDLPQSPIKDMTGTNSLKWISS-KVRLMK
CAN63090   -------MADDNKSSHKLSVFKKEEGDE-------------GNKSTEKWMSSKMRLMR
CAO65359   -------MISDQTGAQKPSNTALNFGDH-------------KQQS----LPSET-----
A0JPW8     -------MLDHSEKVLLVDSETMKTRAE-------------------------------
CAO44870   -------MNNKNP----------------------------------------------
A5BCR3     -------MMDLSKK---------------------------------------------
A2XNM3     -------MDSSSVEKGS------------------------------------------
Q5JNB8     -------MDMDSSSSPV------------------------------------------
Q8LC79     SSSLVDCTLSLGTPSTRLCEEDEKRRSTSSGASSCISNFWDLIHTKNNNSKTAPYNNVP
```

FIGURE 12 (continued)

| | | | |
|---|---|---|---|
| GATAp | NNKQHANG------- | ---------------- | ---STSKWMSTPPMKMRIIRKG--AATDPEG |
| A2X2I3 | NNKQHANG------- | ---------------- | ---STSKWMSTPPMKMRIIRKG--AATDPEG |
| A3A4M7 | NNKQHANG------- | ---------------- | ---STSKWMSTPPMKMRIIRKG--AATDPEG |
| A3BCY3 | LQASCGLAK------ | ---------------- | ---VVAGGKWSAVPAAKMKITRKMGEPSSGVTG |
| A2YE96 | LQASCGLAK------ | ---------------- | ---VVAGGKWSAVPAAKMKITRKMGEPSSGVTG |
| Q5Z624 | LQASCGLAK------ | ---------------- | ---VVAGGKWSAVPAAKMKITRKMGEPSSGVTG |
| Q8LC59 | --------------- | ---------------- | -------------------------------- |
| AAB61058 | MTSSWSPGTHQAVETMFLTVSETEEAGMFDVHFANVNLGSPRARWCKVKAAFKVRAAFKE |
| ABK28715 | --------------- | ---------------- | -------------------------------- |
| AAM63829 | --------------- | ---------------- | -------------------------------- |
| Q1EBW4 | KTITNNKQL------ | ---------------- | ---IDQTNNNNHKESDHYPLNHKTNFDEDHHED |
| AAL38250 | KTITNNKQL------ | ---------------- | ---IDQTNNNNHKESDHYPLNHKTNFDEDHHED |
| CAB79470 | K---KKAI------- | ---------------- | ---ITTSDSSKQ----------HTNNDQ---- |
| CAN63090 | KMMNSDCTT------ | ---------------- | ---AKIEQKVEDHQ------------------ |
| CAO65359 | --------------- | ---------------- | -------------------------------- |
| A0JPW8 | --------------- | ---------------- | -------------------------------- |
| CAO44870 | --------------- | ---------------- | -------------------------------- |
| A5BCR3 | --------------- | ---------------- | -------------------------------- |
| A2XNM3 | --------------- | ---------------- | -------------------------------- |
| Q5JNB8 | --------------- | ---------------- | -------------------------------- |
| Q8LC79 | SFSANKPSR------ | ---------------- | -------------------------------- |

FIGURE 12 (continued)

```
GATAp       GAVR-----KPRRR-AQAHQDESQQ-QLQQALGVVRVCSDCNTTKTPLWRSGPCGPKSLC
A2X2I3      GAVR-----KPRRR-AQAHQDESQQ-QLQQALGVVRVCSDCNTTKTPLWRSGPCGPKSLC
A3A4M7      GAVR-----KPRRR-AQAHQDESQQ-QLQQALGVVRVCSDCNTTKTPLWRSGPCGPKSLC
A3BCY3      GAATTVAPKKPRRRPAQAYEDHGHGGAMGQAFGVIRVCSDCNTTKTPLWRSGPCGPKSLC
A2YE96      GAATTVAPKKPRRRLAQAYEDHGHGGAMGQAFGVIRVCSDCNTTKTPLWRSGPCGPKSLC
Q5Z624      GAATTVAPKKPRRRPAQAYEDHGHGGAMGQAFGVIRVCSDCNTTKTPLWRSGPCGPKSLC
Q8LC59      -----MDPR---KLLSCSSSYVSVRMKEEKGTIRCCSECKTTKTPMWRGGPTGPKSLC
AAB61058    VRRHTTARNPREGLKLLSCSSSYVSVRMKEEKGTIRCCSECKTTKTPMWRGGPTGPKSLC
ABK28715    -----MDPR---KLLSCSSSYVSVRMKEEKGTIRCCSECKTTKTPMWRGGPTGPKSLC
AAM63829    -----MDPR---KLLSCSSSYVSMRMKEEKGTIRCCSECKTTKTPMWRGGPTGPKSLC
Q1EBW4      LNFKNVLTRKTTAATTENRYNTINENGYSNNNGVIRVCSDCNTTKTPLWRSGPRGPKSLC
AAL38250    LNFKNVLTRKTTAATTENRYNTINENGYSNNNGVIRVCSDCNTTKTPLWRSGPRGPKSLC
CAB79470    ----------SSNLSNSERQNGY-NNDCVIRICSDCNTTKTPLWRSGPRGPKSLC
CAN63090    ----------QWDNINEXNSSNN-TSNIPIRVCSDCNTTKTPLWRSGPRGPKSLC
CAO65359    ----------DYNSINSSNI-NSNNTIRVCADCNTTKTPLWRSGPRGPKSLC
A0JPW8      ----------DMIEQNNTSVNDKKKTCADCGTSKTPLWRGGPVGPKSLC
CAO44870    ----------DAVSSAESQVNEPKKTCADCGTTKTPLWRGGPAGPKSLC
A5BCR3      ----------ESLS---EEMNEIKKCCTDCKTTKTPLWRGGPAGPKSLC
A2XNM3      ----------GSIDPDERTASGEPKACTDCHTTKTPLWRGGPSGPKSLC
Q5JNB8      ----------DKVDPDECNGS---KACADCHTTKTPLWRGPGGPKSLC
Q8LC79      ----------GCSGGGGGGGGGDSLLARRCANCDTTSTPLWRNGPRGPKSLC
                                      *      *  :    *****  * *****
```

FIGURE 12 (continued)

| | |
|---|---|
| GATAp | NACGIRQRKARRAMAAAANG-GAAVAPAKSVAAAPVNN----KPAAKKEKRAADVDRSLP |
| A2X2I3 | NACGIRQRKARRAMAAAANG-GAAVAPAKSVAAAPVNN----KPAAKKEKRAADVDRSLP |
| A3A4M7 | NACGIRQRKARRAMAAAANGRSGRWRRQRGVAAAPVNN----KPAAKKEKRAADVDRSLP |
| A3BCY3 | NACGIRQRKARRAMMASGLPASPNAAGPKAAAHSGAAAVAAAQPKVKKEKRADVDRSSLP |
| A2YE96 | NACGIRQRKARRAMMASGLPASPNAAGPKAAAHSGAAAVAAAQPKVKKEKRADVDRSSLP |
| Q5Z624 | NACGIRQRKARRAMMASGLPASPNAAGPKAAAHSG------------------------ |
| Q8LC59 | NACGIRHRKQRRSELLGIHIIRSHKS---------------------------------- |
| AAB61058 | NACGIRHRKQRRSELLGIHIIRSHKS---------------------------------- |
| ABK28715 | NACGIRHRKQRRSELLGIHIIRSHKS---------------------------------- |
| AAM63829 | NACGIRHRKQRRSELLGIHIIRSHKS---------------------------------- |
| Q1EBW4 | NACGIRQRKARRAAMAAAAAAGDQEVAVAPRVQQLPLKKKLQNKKKRSNGGE-------- |
| AAL38250 | NACGIRQRKARRAAMAAAAAAGDQEVAVAPRVQQLPLKKNLQNKKKRSNGGE-------- |
| CAB79470 | NACGIRQRKARRAAMATATAT----AVSG-VSPPVMKKKMQNKNKISNG---------- |
| CAN63090 | NACGIRQRKARRAMAAAAAAA---ANGTAVGTEISPMKMKLPNKEKKMHT---------- |
| CAO65359 | NACGIRQRKARRAMAAAAAT----ANGTILPTNTAPTKTKAKHKDKKSSN---------- |
| A0JPW8 | NACGIRNRKKKRRGGTEDNKKL--------KKSSSGGGNRKFG---------------- |
| CAO44870 | NACGIRSRKKRRAFLGSSNHS---------HNNGGGNGNNKLG---------------- |
| A5BCR3 | NACGIRYRKKRRSSMVGVNKKK--------ERMNS--GSHDLS---------------- |
| A2XNM3 | NACGIRYRKKRREALGLDAGE---------GGAERQEKKKSKRERG-------------- |
| Q5JNB8 | NACGIRYRKRRRAALGLDSSAT-----ATATDGAEQQKKTKAKKEKAQE---------- |
| Q8LC79 | NACGIRFKKEERRTTAATGNTVVGAAPVQTDQYGHHNSGYNNYHAATNNN---------- |
| | ******  :*  .  |

FIGURE 12 (continued)

```
GATAp      FKKRCKMVD------------HVAAAVAATKPTAAGEVVAAAPKDQDHVIVVGGENAAATSM
A2X2I3     FKKRCKMVD------------HVAAAVAATKPTAAGEVVAAAPKDQDHVIVVGGENAAATSM
A3A4M7     FKKRCKMVD------------HVAAAVAATKPTAAGEVVAAAPKDQDHVIVVGGENAAATSM
A3BCY3     FKKRCKVVQVEDHQTLPAATNAAAAAAMEETAESATVAPPAPTTRGGTL--VDSIGLSW
A2YE96     FKKRCKAVQVEDHQTLPAATNAAAAAAMEETAESATVAPPAPTTRGCTL--VDSIGLSW
Q5Z624     -------------------------ATNAAAAAAMEETAESATVAPPAPTTRGGTL--VDSIGLSW
Q8LC59     ----------------LASKKINLLSSSHGGVAVKKRRS---------------------
AAB61058   ----------------LASKKINLLSSSHGGVAVKKRRS---------------------
ABK28715   ----------------LASKKINLLSSSHGGVAVKKRRS---------------------
AAM63829   ----------------LASKKINLLSSSHGGVAVKKRRS---------------------
Q1EBW4     ----KYNHSPPMVAKAKKCKIKEEEEKEMEAETVAGDSEISKSTTSSNS-----------
AAL38250   ----KYNHSPPMVAKAKKCKIKEEEEKEMEAETVAGDSEISKSTTSSNS-----------
CAB79470   ----VYKILSPLPLKVNTCKRMITLEETALAEDLETQS---NSTMLS-------------
CAN63090   ----SNVGQQKKLCKPPCPPPTE-------------------------------------
CAO65359   ----GHVSHYKKRCKLAAAPSCET------------------------------------
A0JPW8     ----ESLKQSLMDLG---------------------------------------------
CAO44870   ----DSLKRRLFALG---------------------------------------------
A5BCR3     ----ETLKQSLMALGNE-------------------------------------------
A2XNM3     ----EEVTMELRMVGFG-------------------------------------------
Q5JNB8     ----EEVTMELHTVGFRSK-----------------------------------------
Q8LC79     ----NNNGTPWAHHHSTQRVPCNYPAN---------------------------------
```

FIGURE 12 (continued)

```
GATAp       PAQNPISKAAATAAAAAASPAFFHGLPRDEITDAAMLLMTLSCGLVHS------
A2X2I3      PAQNPISKAAAA------ASPAFFHGLPRDEITDAAMLLMTLSCGLVHS------
A3A4M7      PAQNPISKAAATAAAAAASPAFFHGLPRDEITDAAMLLMTLSCGLVHS------
A3BCY3      SKTHAAATASCSFRPSPVAPGFAAAV-QDEITDAAMLLMTLSCGLVRS------
A2YE96      SKTHAAATASCSFRPSPVAPGFAAAV-QDEITDAAMLLMTLSCGLVRS------
Q5Z624      SKTHAAATASCSFRPSPVAPGFAAAV-QDEITDAAMLLMTLSCGLVRS------
Q8LC59      ------------------------------LKEEEQAALCLILLSCSSVLA------
AAB61058    ------------------------------LKEEEQAALCLILLSCSSVLA------
ABK28715    ------------------------------LKEEEQAALCLILLSCSSVLAG-----
AAM63829    ------------------------------LKEEEQAALCLILLSCSSVLA------
Q1EBW4      SISSNKFCFDDLTIMLSKSSAYQQVFPQDE-KEAAVLLMALSYGMVHG------
AAL38250    SISSNKFCFDDLTIMLSKSSAYQQVFPQDE-KEAAVLLMALSYGMVHG------
CAB79470    --SSDNIYFDDLALLLSKSSAYQQVFPQDE-KEAAVLLMALSHGMVHG------
CAN63090    ----KKLCFEDFTSSICKNSGFRRVFPRDE-EEAAILLMALSCDLVYS------
CAO65359    ----KKLCFEDFTISLSKNSAFHRVFLQDEIKEAAILLMALSCGLVHG------
A0JPW8      -------------IRKRSTVEKQRQKLGEEE--QAAVLLMALSYGSVYA------
CAO44870    --------R----EVLLQRSTLGEEE------QAAVLLMALSYGYVYA------
A5BCR3      -------VMMQRQRSSVKKQRRKLGEEE----QAAVLLMALSCGSVFA------
A2XNM3      -------KEVVLKQRRMRRRRRLGEEE-----KAAILLMALSSGVIYA------
Q5JNB8      ---------DAAVFKQRRMRRKCLGEEE----RAAILLMALSSGVIYA------
Q8LC79      ------EIRFMDDYGSGVANNVESDGAHGGVPFLSWRLNVADRASLVHDFTR
```

FIGURE 12 (continued)

SEQ ID NO: 128, GATA-like encoding sequence, *Oryza sativa*
ATGTCTACTATCTACATGAGCCAGCTACCTGCTACTCTCCCTCTAATGGAGGGGGATCAGGATCAG
GGGCTCTACCCAGCCTTCCATAGAGCAAAGGACCCTCCTATCTTGTTCCCTTTCATGATCGACAGC
GCCGTCGAGCACCAAGGGCAAATCTATGGAGATCAGGGCTTGAGGAGGCAGCAGGTTTTGGGTGAA
TCCAATCAACAGTTCAATGATCACATGATGATGGGCGGATCAGATGTCTTCCTCACACCGTCTCCG
TTCCGACCAACCATCCAAAGCATCGGCAGCGACATGATCCAGCGATCATCTTATGATCCATACGAT
ATCGAGAGTAACAACAAGCAGCATGCCAATGGATCAACCAGCAAGTGGATGTCGACGCCGCCAATG
AAGATGAGGATCATAAGGAAGGGGGCGGCAACCGATCCTGAGGGCGGGGCGGTGAGAAAGCCAAGG
AGAAGAGCACAAGCGCACCAGGATGAGAGCCAGCAACAACTGCAGCAAGCTTTGGGTGTCGTTAGA
GTGTGCTCGGACTGCAACACCACCAAGACCCCCTTGTGGAGAAGTGGTCCTTGTGGCCCCAAGTCC
CTTTGCAACGCGTGTGGCATCAGGCAAAGGAAGGCGCGGCGGGCGATGGCCGCTGCTGCCAACGGC
GGAGCGGCGGTGGCGCCGGCAAAGAGCGTGGCCGCGGCGCCGGTGAACAATAAGCCGGCGGCGAAG
AAGGAGAAGAGGGCGGCGGACGTCGACCGGTCGCTGCCGTTCAAGAAACGGTGCAAGATGGTCGAT
CACGTTGCTGCTGCCGTCGCTGCCACCAAGCCCACGGCTGCTGGAGAAGTAGTGGCCGCCGCTCCG
AAGGACCAAGATCACGTCATCGTCGTCGGTGGCGAGAACGCCGCCGCCACCTCCATGCCGGCACAG
AACCCGATATCCAAGGCGGCGGCGACCGCCGCTGCCGCCGCCGCCTCTCCGGCGTTCTTCCACGGC
CTCCCTCGCGACGAGATCACCGACGCCGCCATGCTGCTCATGACCCTATCCTGTGGCCTCGTCCAC
AGCTAG

SEQ ID NO: 129, GATA-like, deduced protein sequence, *Oryza sativa*
MSTIYMSQLPATLPLMEGDQDQGLYPAFHRAKDPPILFPFMIDSAVEHQGQIYGDQGLRRQQVLGE
SNQQFNDHMMMGGSDVFLTPSPFRPTIQSIGSDMIQRSSYDPYDIESNNKQHANGSTSKWMSTPPM
KMRIIRKGAATDPEGGAVRKPRRRAQAHDESQQQLQQALGVVRVCSDCNTTKTPLWRSGPCGPKS
LCNACGIRQRKARRAMAAAANGGAAVAPAKSVAAAPVNNKPAAKKEKRAADVDRSLPFKKRCKMVD
HVAAAVAATKPTAAGEVVAAAPKDQDHVIVVGGENAAATSMPAQNPISKAAATAAAAAASPAFFHG
LPRDEITDAAMLLMTLSCGLVHS

SEQ ID NO: 130, Motif 1c
C(S/A/T)(D/E/N)CXT(T/S/A)(K/S)TP(L/M)WR(S/G/N)GP

SEQ ID NO: 131, Motif 2c
GPKSLCNACGIRX(R/K)K

SEQ ID NO: 132, Motif 3c
(A/S)(A/W)X(L/C)(L/N)(M/L/V)(T/L/A)(L/D)(S/R)

SEQ ID NO: 133, prm10133
GGGGACAAGTTTGTACAAAAAAGCAGGCTTAAACAATGTCTACTATCTACATGAGCCA

SEQ ID NO: 134, prm10134
GGGGACCACTTTGTACAAGAAAGCTGGGTAGCTAGCTAGTTTTGATCAGC

SEQ ID NO: 135, GOS2 promoter, *Oryza sativa*
AATCCGAAAAGTTTCTGCACCGTTTTCACCCCTAACTAACAATATAGGGAACGTGTGCTAAATAT
AAAATGAGACCTTATATATGTAGCGCTGATAACTAGAACTATGCAAGAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATCG
AGGTAGCCATAATTGTCATCAAACTCTTCTTGAATAAAAAAATCTTTCTAGCTGAACTCAATGGGT

FIGURE 14

```
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC

SEQ ID NO: 136, expression cassette
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTCCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGG
```

FIGURE 14 (continued)

TCGATCTCTTCCCTCCTCCACCTCCTCCTCACAGGGTATGTGCCCTTCGGTTGTTCTTGGATTTAT
TGTTCTAGGTTGTGTAGTACGGGCGTTGATGTTAGGAAAGGGGATCTGTATCTGTGATGATTCCTG
TTCTTGGATTTGGGATAGAGGGGTTCTTGATGTTGCATGTTATCGGTTCGGTTTGATTAGTAGTAT
GGTTTTCAATCGTCTGGAGAGCTCTATGGAAATGAAATGGTTTAGGGTACGGAATCTTGCGATTTT
GTGAGTACCTTTTGTTTGAGGTAAAATCAGAGCACCGGTGATTTTGCTTGGTGTAATAAAAGTACG
GTTGTTGGTCCTCGATTCTGGTAGTGATGCTTCTCGATTTGACGAAGCTATCCTTTGTTTATTCC
CTATTGAACAAAATAATCCAACTTTGAAGACGGTCCCGTTGATGAGATTGAATGATTGATTCTTA
AGCCTGTCCAAAATTTCGCAGCTGGCTTGTTTAGATACAGTAGTCCCCATCACGAAATTCATGGAA
ACAGTTATAATCCTCAGGAACAGGGGATTCCCTGTTCTTCCGATTTGCTTTAGTCCCAGAATTTTT
TTTCCCAAATATCTTAAAAAGTCACTTTCTGGTTCAGTTCAATGAATTGATTGCTACAAATAATGC
TTTTATAGCGTTATCCTAGCTGTAGTTCAGTTAATAGGTAATACCCCTATAGTTTAGTCAGGAGAA
GAACTTATCCGATTTCTGATCTCCATTTTTAATTATATGAAATGAACTGTAGCATAAGCAGTATTC
ATTTGGATTATTTTTTTATTAGCTCTCACCCCTTCATTATTCTGAGCTGAAAGTCTGGCATGAAC
TGTCCTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAATCGG
GATAGTTATACTGCTTGTTCTTATGATTCATTTCCTTTGTGCAGTTCTTGGTGTAGCTTGCCACTT
TCACCAGCAAAGTTCATTTAAATCAACTAGGGATATCACAAGTTTGTACAAAAAAGCAGGCTTAAA
CAATGTCTACTATCTACATGAGCCAGCTACCTGCTACTCTCCCTCTAATGGAGGGGGATCAGGATC
AGGGGCTCTACCCAGCCTTCCATAGAGCAAAGGACCCTCCTATCTTGTTCCCTTTCATGATCGACA
GCGCCGTCGAGCACCAAGGGCAAATCTATGGAGATCAGGGCTTGAGGAGGCAGCAGGTTTTGGGTG
AATCCAATCAACAGTTCAATGATCACATGATGATGGGCGGATCAGATGTCTTCCTCACACCGTCTC
CGTTCCGACCAACCATCCAAAGCATCGGCAGCGACATGATCCAGCGATCATCTTATGATCCATACG
ATATCGAGAGTAACAACAAGCAGCATGCCAATGGATCAACCAGCAAGTGGATGTCGACGCCGCCAA
TGAAGATGAGGATCATAAGGAAGGGGCGGCAACCGATCCTGAGGGCGGGGCGGTGAGAAAGCCAA
GGAGAAGAGCACAAGCGCACCAGGATGAGAGCCAGCAACAACTGCAGCAAGCTTTGGGTGTCGTTA
GAGTGTGCTCGGACTGCAACACCACCAAGACCCCCTTGTGGAGAAGTGGTCCTTGTGGCCCCAAGT
CCCTTTGCAACGCGTGTGGCATCAGGCAAAGGAAGGCGCGGCGGGCGATGGCCGCTGCTGCCAACG
GCGGAGCGGCGGTGGCGCCGGCAAAGAGCGTGGCCGCGGCGCCGGTGAACAATAAGCCGGCGGCGA
AGAAGGAGAAGAGGGCGGCGGACGTCGACCGGTCGCTGCCGTTCAAGAAACGGTGCAAGATGGTCG
ATCACGTTGCTGCTGCCGTCGCTGCCACCAAGCCCACGGCTGCTGGAGAAGTAGTGGCCGCCGCTC
CGAAGGACCAAGATCACGTCATCGTCGTCGGTGGCGAGAACGCCGCCGCCACCTCCATGCCGGCAC
AGAACCCGATATCCAAGGCGGCGGCGACCGCCGCTGCCGCCGCCGCCTCTCCGGCGTTCTTCCACG
GCCTCCCTCGCGACGAGATCACCGACGCCGCCATGCTGCTCATGACCCTATCCTGTGGCCTCGTCC
ACAGCTAG

SEQ ID NO: 137, EAY85043, Putative uncharacterized protein Oryza sativa (indica cultivar-group)
ATGTCTACTATCTACATGAGCCAGCTACCTGCTACTCTCCCTCTAATGGAGGGGGATCAGGATCAG
GGGCTCTACCCAGCCTTCCATAGAGCAAAGGACCCTCCTATCTTGTTCCCTTTCATGATCGACAGC
GCCGTCGAGCACCAAGGGCAAATCTATGGAGATCAGGGCTTGAGGAGGCAGCAGGTTTTGGGTGAA
TCCAATCAACAGTTCAATGATCACATGATGATGGGCGGATCAGATGTCTTCCTCACACCGTCTCCG
TTCCGACCAACCATCCAAAGCATCGGCAGTGACATGATCCAGCGATCATCTTATGATCCATACGAT
ATCGAGAGTAACAACAAGCAGCATGCCAATGGATCAACCAGCAAGTGGATGTCGACGCCGCCAATG
AAGATGAGGATCATAAGGAAGGGGCGGCAACCGATCCTGAGGGCGGGGCGGTGAGAAAGCCAAGG
AGAAGAGCACAAGCGCACCAGGATGAGAGCCAGCAACAACTGCAGCAAGCTTTGGGTGTCGTTAGA
GTGTGCTCGGACTGCAACACCACCAAGACCCCCTTGTGGAGAAGTGGTCCTTGTGGCCCCAAGTCC
CTTTGCAACGCGTGTGGCATCAGGCAAAGGAAGGCGCGGCGGGCGATGGCCGCTGCTGCCAACGGC
GGAGCGGCGGTGGCGCCGGCAAAGAGCGTGGCCGCGGCGCCGGTGAACAATAAGCCGGCGGCGAAG

FIGURE 14 (continued)

AAGGAGAAGAGGGCGGCGGACGTCGACCGGTCGCTGCCGTTCAAGAAACGGTGCAAGATGGTCGAT
CACGTTGCTGCTGCCGTCGCTGCCACCAAGCCCACGGCTGCTGGAGAAGTAGTGGCCGCCGCTCCG
AAGGACCAAGATCACGTCATCGTCGTCGGTGGCGAGAACGCCGCCGCCACCTCCATGCCGGCACAG
AACCCGATATCCAAGGCGGCGGCGGCCTCTCCGGCGTTCTTCCACGGCCTCCCTCGCGACGAGATC
ACCGACGCCGCCATGCTGCTCATGACCCTATCCTGTGGCCTCGTCCACAGCTAG

SEQ ID NO: 138, A2X2I3 ORYSI, Putative uncharacterized protein Oryza sativa (indica cultivar-group)
MSTIYMSQLPATLPLMEGDQDQGLYPAFHRAKDPPILFPFMIDSAVEHQGQIYGDQGLRRQQVLGE
SNQQFNDHMMMGGSDVFLTPSPFRPTIQSIGSDMIQRSSYDPYDIESNNKQHANGSTSKWMSTPPM
KMRIIRKGAATDPEGGAVRKPRRRAQAHQDESQQQLQQALGVVRVCSDCNTTKTPLWRSGPCGPKS
LCNACGIRQRKARRAMAAAANGGAAVAPAKSVAAAPVNNKPAAKKEKRAADVDRSLPFKKRCKMVD
HVAAAVAATKPTAAGEVVAAAPKDQDHVIVVGGENAAATSMPAQNPISKAAAASPAFFHGLPRDEI
TDAAMLLMTLSCGLVHS

SEQ ID NO: 139, EAZ22266, Oryza sativa (japonica cultivar-group) hypothetical protein
ATGTCTACTATCTACATGAGCCAGCTACCTGCTACTCTCCCTCTAATGGAGGGGGATCAGGATCAG
GGGCTCTACCCAGCCTTCCATAGAGCAAAGGACCCTCCTATCTTGTTCCCTTTCATGATCGACAGC
GCCGTCGAGCACCAAGGGCAAATCTATGGAGATCAGGGCTTGAGGAGGCAGCAGGTTTTGGGTGAA
TCCAATCAACAGTTCAATGATCACATGATGATGGGCGGATCAGATGTCTTCCTCACACCGTCTCCG
TTCCGACCAACCATCCAAAGCATCGGCAGCGACATGATCCAGCGATCATCTTATGATCCATACGAT
ATCGAGAGTAACAACAAGCAGCATGCCAATGGATCAACCAGCAAGTGGATGTCGACGCCGCCAATG
AAGATGAGGATCATAAGGAAGGGGCGGCAACCGATCCTGAGGGCGGGGCGGTGAGAAAGCCAAGG
AGAAGAGCACAAGCGCACCAGGATGAGAGCCAGCAACAACTGCAGCAAGCTTTGGGTGTCGTTAGA
GTGTGCTCGGACTGCAACACCACCAAGACCCCCTTGTGGAGAAGTGGTCCTTGTGGCCCCAAGTCC
CTTTGCAACGCGTGTGGCATCAGGCAAAGGAAGGCGCGGCGGGCGATGGCCGCTGCTGCCAACGGG
CGGAGCGGCCGGTGGCGCCGGCAAAGAGGCGTGGCCGCGGCGCCGGTGAACAATAAGCCGGCGGCG
AAGAAGGAGAAGAGGGCGGCGGACGTCGACCGGTCGCTGCCGTTCAAGAAACGGTGCAAGATGGTC
GATCACGTTGCTGCTGCCGTCGCTGCCACCAAGCCCACGGCTGCTGGAGAAGTAGTGGCCGCCGCT
CCGAAGGACCAAGATCACGTCATCGTCGTCGGTGGCGAGAACGCCGCCGCCACCTCCATGCCGGCA
CAGAACCCGATATCCAAGGCGGCGGCGACCGCCGCTGCCGCCGCCGCCTCTCCGGCGTTCTTCCAC
GGCCTCCCTCGCGACGAGATCACCGACGCCGCCATGCTGCTCATGACCCTATCCTGTGGCCTCGTC
CACAGCTAG

SEQ ID NO: 140, A3A4M7 ORYSJ, Putative uncharacterized protein OsJ_005749 Oryza sativa (japonica cultivar-group)
MSTIYMSQLPATLPLMEGDQDQGLYPAFHRAKDPPILFPFMIDSAVEHQGQIYGDQGLRRQQVLGE
SNQQFNDHMMMGGSDVFLTPSPFRPTIQSIGSDMIQRSSYDPYDIESNNKQHANGSTSKWMSTPPM
KMRIIRKGAATDPEGGAVRKPRRRAQAHQDESQQQLQQALGVVRVCSDCNTTKTPLWRSGPCGPKS
LCNACGIRQRKARRAMAAAANGRSGRWRRQRGVAAAPVNNKPAAKKEKRAADVDRSLPFKKRCKMV
DHVAAAVAATKPTAAGEVVAAAPKDQDHVIVVGGENAAATSMPAQNPISKAAATAAAAAASPAFFH
GLPRDEITDAAMLLMTLSCGLVHS

FIGURE 14 (continued)

SEQ ID NO: 141, EAZ37422, Oryza sativa (japonica cultivar-group) hypothetical protein
ATGGAGGGGGAGCACCACCATCACCACCAGGATCATCACCAAGGCCACTTCCAAGCCTTCTCCCTG
CAGCCTAAGGATCCCCCAGTCTTATTCCCCTTTGTGATCAGTAGAAGAAGCAGCAGCAGCAGCCCT
AGCGACAGCACCACTCTAAGCTATGGTTCAGACCATCACTTGACACAGCAGCAGCAGCATCAGCAT
CAAGCCATGCTTGAGCCCCAAAATATGATTGGAGGATCATCCGCTGGCATCTTTGCGACGCCGTTC
CCGACCGTCAAGAGCATCCGCGACGACATGATCGAGCGGTCGCAGTTCGATCCATACGATACCGAG
AAGCTGCAGGCGAGCTGCGGGTTAGCCAAGGTCGTCGCCGGCGGCAAGTGGAGCGCGGTGCCAGCG
GCCAAGATGAAGATCACGAGGAAGATGGGTGAGCCGTCGTCCGGTGTCACTGGCGGGCTGCGACG
ACGGTGGCGCCGAAGAAGCCGAGGAGGAGGCCGGCGCAGGCGTACGAGGATCACGGCCATGGCGGC
GCCATGGGCCAAGCTTTTGGCGTGATTAGGGTGTGCTCCGACTGCAACACCACCAAGACTCCCTTG
TGGAGGAGTGGCCCGTGCGGCCCCAAGTCGCTTTGCAACGCGTGCGGCATCAGGCAGAGGAAGGCG
CGGCGGGCGATGATGGCCTCCGGACTACCAGCGTCCCCAACGCCGCCGGCCCCAAGGCGGCCGCA
CATAGCGGCGCCGCTGCGGTGGCGGCTGCGCAGCCGAAGGTGAAGAAGGAGAAGAGAGCCGACGTC
GACCGGTCGTCGCTGCCGTTCAAGAAACGGTGCAAGGTCGTCCAGGTCGAGGATCATCAAACGCTG
CCCGCCGCCACAAACGCAGCCGCCGCAGCTGCCATGGAGGAGACGGCCGAGTCCGCCACCGTCGCC
CCGCCCCCGGCGCCGACGACGAGGGGTGGTACTCTCGTCGACAGCATCGGGCTCAGCTGGAGCAAG
ACCCATGCCGCCGCCACCGCCTCCTGCAGCTTCCGGCCGTCACCGGTGGCTCCCGGCTTCGCGGCG
GCGGTGCAGGACGAGATCACTGACGCCGCCATGCTGCTCATGACGCTGTCCTGCGGGCTTGTCCGG
AGCTGA

SEQ ID NO: 142, A3BCY3 ORYSJ hypothetical protein OsJ_020905 [Oryza sativa (japonica cultivar-group)]
MEGEHHHHHQDHHQGHFQAFSLQPKDPPVLFPFVISRRSSSSSPSDSTTLSYGSDHHLTQQQQHQH
QAMLEPQNMIGGSSAGIFATPFPTVKSIRDDMIERSQFDPYDTEKLQASCGLAKVVAGGKWSAVPA
AKMKITRKMGEPSSGVTGGAATTVAPKKPRRRPAQAYEDHGHGGAMGQAFGVIRVCSDCNTTKTPL
WRSGPCGPKSLCNACGIRQRKARRAMMASGLPASPNAAGPKAAAHSGAAAVAAAQPKVKKEKRADV
DRSSLPFKKRCKVVQVEDHQTLPAATNAAAAAAMEETAESATVAPPPAPTTRGGTLVDSIGLSWSK
THAAATASCSFRPSPVAPGFAAAVQDEITDAAMLLMTLSCGLVRS

SEQ ID NO: 143, EAZ01407, Oryza sativa (indica cultivar-group) hypothetical protein
ATGGAGGGGGAGCACCACCAGGATCATCACCAAGGCCACTTCCAAGCCTTCTCCCTGCAGCCTAAG
GATCCCCCAGTCTTATTCCCCTTTGTGATCAATAGAAGAAGCAGCAGCAGCAGCCCTAGCGACAGC
ACCACTCTAAGCTATGGTTCAGACCATCACTTGACACAGCAGCAGCAGCATCAGCATCAAGCCATG
CTTGAGCCCCAACATATGATTGGAGGATCATCCGCTGGCATCTTTGCGACGCCGTTCCCGACCGTC
AAGAGCATCCGCGACGACATGATCGAGCGGTCGCAGTTCGATCCATACGATACCGAGAAGCTGCAG
GCGAGCTGCGGGTTAGCCAAGGTCGTCGCCGGCGGCAAGTGGAGCGCGGTGCCAGCGGCCAAGATG
AAGATCACGAGGAAGATGGGTGAGCCGTCGTCCGGTGTCACTGGCGGGCTGCGACGACGGTGGCG
CCGAAGAAGCCGAGGAGGAGGCTGGCGCAGGCGTACGAGGATCACGGCCATGGCGGCGCCATGGGC
CAAGCTTTTGGCGTGATTAGGGTGTGCTCCGACTGCAACACCACCAAGACTCCCTTGTGGAGGAGT
GGCCCGTGCGGCCCCAAGTCGCTTTGCAACGCGTGCGGCATCAGGCAGAGGAAGGCGCGGCGGGCG
ATGATGGCCTCCGGACTACCAGCGTCCCCAACGCCGCCGGCCCCAAGGCGGCCGCACATAGCGGC
GCCGCTGCGGTGGCGGCTGCGCAGCCGAAGGTGAAGAAGGAGAAGAGAGCCGACGTCGACCGGTCG
TCGCTGCCGTTCAAGAAACGGTGCAAGGCCGTCCAGGTCGAGGATCATCAAACGCTGCCCGCCGCC
ACAAACGCAGCCGCCGCAGCTGCCATGGAGGAGACGGCCGAGTCCGCCACCGTCGCCCCGCCCCCG
GCGCCGACGACGAGGGGTTGTACTCTCGTCGACAGCATCGGGCTCAGCTGGAGCAAGACCCATGCC
GCCGCCACCGCCTCCTGCAGCTTCCGGCCGTCACCGGTGGCTCCCGGCTTCGCGGCGGCGGTGCAG
GACGAGATCACTGACGCCGCCATGCTGCTCATGACGCTGTCCTGCGGGCTTGTCCGGAGCTGA

FIGURE 14 (continued)

SEQ ID NO: 144, A2YE96 ORYSI, Putative uncharacterized protein OsI_022639 Oryza sativa (indica cultivar-group)
MEGEHHQDHHQGHFQAFSLQPKDPPVLFPFVINRRSSSSSPSDSTTLSYGSDHHLTQQQQHQHQAM
LEPQHMIGGSSAGIFATPFPTVKSIRDDMIERSQFDPYDTEKLQASCGLAKVVAGGKWSAVPAAKM
KITRKMGEPSSGVTGGAATTVAPKKPRRRLAQAYEDHGHGGAMGQAFGVIRVCSDCNTTKTPLWRS
GPCGPKSLCNACGIRQRKARRAMMASGLPASPNAAGPKAAAHSGAAAVAAAQPKVKKEKRADVDRS
SLPFKKRCKAVQVEDHQTLPAATNAAAAAAMEETAESATVAPPPAPTTRGCTLVDSIGLSWSKTHA
AATASCSFRPSPVAPGFAAAVQDEITDAAMLLMTLSCGLVRS

SEQ ID NO: 145, BAD61831, Oryza sativa (japonica cultivar-group) zinc finger protein-like
ATGTCTACCATCTACATGAGTCAGCTCTCAGCTGCTCTCCCTCTCATGGAGGGGGAGCACCACCAT
CACCACCAGGATCATCACCAAGGCCACTTCCAAGCCTTCTCCCTGCAGCCTAAGGATCCCCCAGTC
TTATTCCCCTTTGTGATCAGTAGAAGAAGCAGCAGCAGCAGCCCTAGCGACAGCACCACTCTAAGC
TATGGTTCAGACCATCACTTGACACAGCAGCAGCAGCATCAGCATCAAGCCATGCTTGAGCCCCAA
AATATGATTGGAGGATCATCCGCTGGCATCTTTGCGACGCCGTTCCCGACCGTCAAGAGCATCCGC
GACGACATGATCGAGCGGTCGCAGTTCGATCCATACGATACCGAGAAGCTGCAGGCGAGCTGCGGG
TTAGCCAAGGTCGTCGCCGGCGGCAAGTGGAGCGCGGTGCCAGCGGCCAAGATGAAGATCACGAGG
AAGATGGGTGAGCCGTCGTCCGGTGTCACTGGCGGGGCTGCGACGACGGTGGCGCCGAAGAAGCCG
AGGAGGAGGCCGGCGCAGGCGTACGAGGATCACGGCCATGGCGGCGCCATGGGCCAAGCTTTTGGC
GTGATTAGGGTGTGCTCCGACTGCAACACCACCAAGACTCCCTTGTGGAGGAGTGGCCCGTGCGGC
CCCAAGTCGCTTTGCAACGCGTGCGGCATCAGGCAGAGGAAGGCGCGGCGGGCGATGATGGCCTCC
GGACTACCAGCGTCCCCCAACGCCGCCGGCCCCAAGGCGGCCGCACATAGCGGCGCCACAAACGCA
GCCGCCGCAGCTGCCATGGAGGAGACGGCCGAGTCCGCCACCGTCGCCCCGCCCCGGCGCCGACG
ACGAGGGGTGGTACTCTCGTCGACAGCATCGGGCTCAGCTGGAGCAAGACCCATGCCGCCGCCACC
GCCTCCTGCAGCTTCCGGCCGTCACCGGTGGCTCCCGGCTTCGCGGCGGCGGTGCAGGACGAGATC
ACTGACGCCGCCATGCTGCTCATGACGCTGTCCTGCGGGCTTGTCCGGAGCTGA

SEQ ID NO: 146, Q5Z624 ORYSJ|Q5Z624 name|Zinc finger protein-like (Os06g0571800 protein) Oryza sativa (japonica cultivar-group)
MSTIYMSQLSAALPLMEGEHHHHHQDHHQGHFQAFSLQPKDPPVLFPFVISRRSSSSSPSDSTTLS
YGSDHHLTQQQQHQHQAMLEPQNMIGGSSAGIFATPFPTVKSIRDDMIERSQFDPYDTEKLQASCG
LAKVVAGGKWSAVPAAKMKITRKMGEPSSGVTGGAATTVAPKKPRRRPAQAYEDHGHGGAMGQAFG
VIRVCSDCNTTKTPLWRSGPCGPKSLCNACGIRQRKARRAMMASGLPASPNAAGPKAAAHSGATNA
AAAAAMEETAESATVAPPPAPTTRGGTLVDSIGLSWSKTHAAATASCSFRPSPVAPGFAAAVQDEI
TDAAMLLMTLSCGLVRS

SEQ ID NO: 147, ABE66183, Arabidopsis thaliana (thale cress) zinc finger family protein
ATGGATCCAAGGAAGCTACTATCTTGTTCATCCTCTTACGTGTCAGTGAGAATGAAAGAAGAGAAG
GGGACAATTAGGTGTTGCAGTGAGTGTAAGACCACCAAGACACCAATGTGGAGAGGTGGACCAACT
GGTCCTAAGTCACTTTGCAATGCATGTGGAATTAGACACAGAAAACAGAGACGATCAGAGTTATTG
GGTATTCATATTATTCGCAGCCACAAAAGCTTAGCCTCCAAGAAGATAAACCTATTATCATCATCA
CACGGTGGCGTGGCGGTGAAGAAACGAAGGAGTCTAAAGGAGGAAGAACAAGCTGCTTTGTGTCTA
TTGTTATTGTCTTGTAGCTCTGTTTTGGCCTGA

FIGURE 14 (continued)

SEQ ID NO: 148, Q8LC59.2|GAT22_ARATH GATA transcription factor 22 Arabidopsis thaliana
MDPRKLLSCSSSYVSVRMKEEKGTIRCCSECKTTKTPMWRGGPTGPKSLCNACGIRHRKQRRSELL
GIHIIRSHKSLASKKINLLSSSHGGVAVKKRRSLKEEEQAALCLLLLSCSSVLA

SEQ ID NO: 149, (gi|2191157:78100-78574, 78949-79287, 79392-79878, 81037-81166, 81274-81495) Arabidopsis thaliana BAC F2P16, GATA-type zinc finger protein complete sequence
ATGGAGCGATCTCGCTCAGAAACGCCATCGTCTCGCTCACGATTGAAGCTGTGCTTCATAAACTCG
CCGCCATCATCGATATTCACGGGGTCCAAGATCGAAGCTGAGGATGGTTCTCCGCTTGTGATCGAG
CTCGTGGACGCCACCACAAACACTCTAGTTAGTACGGGACCGTTCTCGTCTTCTCGGGTCGAGCTC
GTGCCGCTGAACGCTGATTTCACGGAAGAAAGCTGGACCGTTGAGGGATTTAATCGGAATATTCTC
ACGCAACGTGAAGGGAAACGTCCGTTGCTCACTGGAGACCTAACGGTGATGCTTAAAAACGGTGTT
GGAGTTATAACCGGAGATATAGCTTTCTCGGATAACTCGAGCTGGACTAGGAGTCGGAAGTTCCGG
TTAGGTGCTAAGTTGACCGGAGATGGAGCCGTGGAGGCGAGAAGTGAAGCTTTTGGATGTAGAGAC
CAACGAGGAGAATGGGTCTCAAAGAAAACATGGAACACAATTGTATCACATGCCATGGATTGCGTT
TTGGACGAAACAGAGTGTTACATTTACAATGCAAACACTCCGGGCGTAACACTTCTCTTCAACTCT
GTTTATGAGTTGATAAGAGTGTCATTCAATGGCAACGATATCCAAAACCTTGATCAGCCAATTCTA
GACCAATTAAAGGCCGAAGCTTATCAAAACCTTAACCGCATTACAGCGGTTAACGATAGGACCTTT
GTGGGTCATCCACAAAGGTCCTTACAGTGCCCGCAAGATCCTGGATTTGTCGTAACATGTTCTGGA
TCGCAGCACATCGACTTTCAAGGAAGTTTGGATCCATCAAGCTCTTCGATGGCTCTTTGCCACAAA
GCTTCAAGCTCAACGGTCCACCCTGATGTCCTGATGAGTTTTGATAACTCATCAACCGCGAGGTTT
CATATCGACAAAAAGTTCTTACCGACTTTCGGAAACAGCTTCAAAGTAAGTGAACTCGATCAAGTA
CACGGAAAATCACAAACTGTTGTGACAAAAGGTTGTATAGAGAATAACGAGGAGGATGAGAACGCG
TTTTCTTATCATCACCATGATGACATGACCTCAAGCTGGTCACCTGGTACGCACCAAGCCGTTGAA
ACGATGTTTCTTACCGTGTCTGAGACGGAAGAAGCTGGAATGTTCGATGTTCATTTTGCAAACGTT
AATTTGGGATCTCCAAGAGCCAGGTGGTGTAAGGTTAAGGCAGCTTTCAAGGTTAGGGCAGCTTTT
AAGGAAGTCCGGAGACACACAACTGCCAGAAATCCGAGGGAAGGCTTGAAGCTACTATCTTGTTCA
TCCTCTTACGTGTCAGTGAGAATGAAAGAAGAGAAGGGGACAATTAGGTGTTGCAGTGAGTGTAAG
ACCACCAAGACACCAATGTGGAGAGGTGGACCAACTGGTCCTAAGTCACTTTGCAATGCATGTGGA
ATTAGACACAGAAAACAGAGACGATCAGAGTTATTGGGTATTCATATTATTCGCAGCCACAAAAGC
TTAGCCTCCAAGAAGATAAACCTATTATCATCATCACACGGTGGCGTGGCGGTGAAGAAACGAAGG
AGTCTAAAGGAGGAAGAACAAGCTGCTTTGTGTCTATTGTTATTGTCTTGTAGCTCTGTTTTGGCC
TAA

SEQ ID NO: 150, AAB61058.1 contains similarity to GATA-type zinc fingers (PS:PS00344) [Arabidopsis thaliana]
MERSRSETPSSRSRLKLCFINSPPSSIFTGSKIEAEDGSPLVIELVDATTNTLVSTGPFSSSRVEL
VPLNADFTEESWTVEGFNRNILTQREGKRPLLTGDLTVMLKNGVGVITGDIAFSDNSSWTRSRKFR
LGAKLTGDGAVEARSEAFGCRDQRGEWVSKKTWNTIVSHAMDCVLDETECYIYNANTPGVTLLFNS
VYELIRVSFNGNDIQNLDQPILDQLKAEAYQNLNRITAVNDRTFVGHPQRSLQCPQDPGFVVTCSG
SQHIDFQGSLDPSSSSMALCHKASSSTVHPDVLMSFDNSSTARFHIDKKFLPTFGNSFKVSELDQV
HGKSQTVVTKGCIENNEEDENAFSYHHHDDMTSSWSPGTHQAVETMFLTVSETEEAGMFDVHFANV
NLGSPRARWCKVKAAFKVRAAFKEVRRHTTARNPREGLKLLSCSSSYVSVRMKEEKGTIRCCSECK
TTKTPMWRGGPTGPKSLCNACGIRHRKQRRSELLGIHIIRSHKSLASKKINLLSSSHGGVAVKKRR
SLKEEEQAALCLLLLSCSSVLA

FIGURE 14 (continued)

SEQ ID NO: 151, DQ653310 gi|116831524:1-363 Arabidopsis thaliana clone 0000012664_0000009184 unknown mRNA
ATGGATCCAAGGAAGCTACTATCTTGTTCATCCTCTTACGTGTCAGTGAGAATGAAAGAAGAGAAG
GGGACAATTAGGTGTTGCAGTGAGTGTAAGACCACCAAGACACCAATGTGGAGAGGTGGACCAACT
GGTCCTAAGTCACTTTGCAATGCATGTGGAATTAGACACAGAAAACAGAGACGATCAGAGTTATTG
GGTATTCATATTATTCGCAGCCACAAAAGCTTAGCCTCCAAGAAGATAAACCTATTATCATCATCA
CACGGTGGCGTGGCGGTGAAGAAACGAAGGAGTCTAAAGGAGGAAGAACAAGCTGCTTTGTGTCTA
TTGTTATTGTCTTGTAGCTCTGTTTTGGCCGGA

SEQ ID NO: 152, ABK28715.1 unknown [Arabidopsis thaliana]
MDPRKLLSCSSSYVSVRMKEEKGTIRCCSECKTTKTPMWRGGPTGPKSLCNACGIRHRKQRRSELL
GIHIIRSHKSLASKKINLLSSSHGGVAVKKRRSLKEEEQAALCLLLLSCSSVLAG

SEQ ID NO: 153, AY086778, gi|21405488:127-489 Arabidopsis thaliana clone 27625 mRNA, complete sequence
ATGGATCCAAGGAAGCTACTATCTTGTTCATCCTCTTACGTGTCAATGAGAATGAAAGAAGAGAAG
GGGACAATTAGGTGTTGCAGTGAGTGTAAGACCACCAAGACACCAATGTGGAGAGGTGGACCAACT
GGTCCTAAGTCACTTTGCAATGCATGTGGAATTAGACACAGAAAACAGAGACGATCAGAGTTATTG
GGTATTCATATTATTCGCAGCCACAAAAGCTTAGCCTCCAAGAAGATAAACCTATTATCATCATCA
CACGGTGGCGTGGCGGTGAAGAAACGAAGGAGTCTAAAGGAGGAAGAACAAGCTGCTTTGTGTCTA
TTGTTATTGTCTTGTAGCTCTGTTTTGGCCTAA

SEQ ID NO: 154, AAM63829.1| unknown [Arabidopsis thaliana]
MDPRKLLSCSSSYVSMRMKEEKGTIRCCSECKTTKTPMWRGGPTGPKSLCNACGIRHRKQRRSELL
GIHIIRSHKSLASKKINLLSSSHGGVAVKKRRSLKEEEQAALCLLLLSCSSVLA

SEQ ID NO: 155, ABG25059, Arabidopsis thaliana (thale cress) At5g56860 mRNA
ATGGATTCAAATTTTCATTACTCGATAGATCTTAACGAAGATCAAAACCATCACGAACAACCCTTT
TTCTATCCTCTTGGATCCTCTTCCTCGCTTCATCATCATCATCATCATCATCATCATCAAGTCCCT
TCTAATTCTTCATCTTCTTCTTCGTCCATTTCATCGCTCTCCTCTTACCTCCCTTTCTTGATCAAC
TCTCAAGAAGATCAACATGTTGCCTACAACAACACTTATCACGCTGATCATCTCCATCTTTCTCAA
CCCCTCAAGGCCAAGATGTTTGTGGCTAACGGTGGATCATCAGCATGCGATCACATGGTGCCAAAG
AAGGAGACAAGACTGAAACTAACGATAAGGAAAAAGATCACGAAGACCAACCCCATCCTCTTCAT
CAAAACCCGACAAAACCCGATTCAGACTCCGACAAGTGGTTGATGTCCCCAAAGATGCGGTTGATC
AAGAAAACAATCACCAACAATAAACAGCTCATTGATCAGACTAATAATAATAATCATAAAGAAAGT
GATCACTACCCTTTGAATCATAAGACTAATTTCGACGAGGATCACCATGAAGATCTTAATTTCAAG
AACGTCTTGACCAGGAAGACCACGGCCGCGACCACCGAGAATCGCTACAATACAATCAACGAGAAC
GGTTATAGTAATAACAATGGCGTGATTAGGGTTTGTTCGGATTGTAACACCACCAAGACTCCTCTT
TGGCGAAGTGGACCTCGAGGTCCCAAGTCTCTTTGTAACGCATGTGGTATACGGCAAAGAAAGGCA
AGGCGAGCCGCTATGGCCGCGGCCGCTGCAGCCGGCGACCAAGAGGTGGCGGTAGCGCCCCGAGTG
CAACAATTACCGCTGAAAAAGAAGTTGCAAAATAAAAAAAAGAGATCAAACGGAGGGGAAAAATAC
AATCACTCTCCTCCAATGGTGGCCAAGGCCAAAAAGTGCAAGATCAAAGAGGAAGAGGAGAAGGAA
ATGGAAGCGGAAACGGTTGCCGGAGATTCAGAGATCAGCAAATCTACAACTTCTTCTAATTCTTCG
ATTTCGTCAAACAAATTTTGTTTCGATGATTTGACAATAATGTTGAGCAAAAGCTCAGCTTATCAA
CAAGTGTTCCCACAAGATGAGAAGGAGGCTGCTGTTTTGCTCATGGCTCTGTCGTATGGAATGGTT
CACGGTTGA

SEQ ID NO: 156, Q1EBW4 ARATH|Q1EBW4 name|At5g56860, GATA transcription factor 24 Arabidopsis thaliana
MDSNFHYSIDLNEDQNHHEQPFFYPLGSSSSLHHHHHHHHQVPSNSSSSSSSISSLSSYLPFLIN
SQEDQHVAYNNTYHADHLHLSQPLKAKMFVANGGSSACDHMVPKKETRLKLTIRKKDHEDQPHPLH
QNPTKPDSDSDKWLMSPKMRLIKKTITNNKQLIDQTNNNNHKESDHYPLNHKTNFDEDHHEDLNFK
NVLTRKTTAATTENRYNTINENGYSNNNGVIRVCSDCNTTKTPLWRSGPRGPKSLCNACGIRQRKA
RRAAMAAAAAAGDQEVAVAPRVQQLPLKKKLQNKKKRSNGGEKYNHSPPMVAKAKKCKIKEEEEKE
MEAETVAGDSEISKSTTSSNSSISSNKFCFDDLTIMLSKSSAYQQVFPQDEKEAAVLLMALSYGMV
HG

SEQ ID NO: 157, AY065074 gi|17473546:66-1262 Arabidopsis thaliana unknown protein (At5g56860; MPI10.2) mRNA, complete cds
ATGGATTCAAATTTTCATTACTCGATAGATCTTAACGAAGATCAAAACCATCACGAACAACCCTTT
TTCTATCCTCTTGGATCCTCTTCCTCGCTTCATCATCATCATCATCATCATCATCAAGTCCCT
TCTAATTCTTCATCTTCTTCTTCGTCCATTTCATCGCTCTCCTCTTACCTCCCTTTCTTGATCAAC
TCTCAAGAAGATCAACATGTTGCCTACAACAACACTTATCACGCTGATCATCTCCATCTTTCTCAA
CCCCTCAAGGCCAAGATGTTTGTGGCTAACGGTGGATCATCAGCATGCGATCACATGGTGCCAAAG
AAGGAGACAAGACTGAAACTAACGATAAGGAAAAAAGATCACGAAGACCAACCCCATCCTCTTCAT
CAAAACCCGACAAAACCCGATTCAGACTCCGACAAGTGGTTGATGTCCCCAAAGATGCGGTTGATC
AAGAAAACAATAACCAACAATAAACAGCTCATTGATCAGACTAATAATAATAATCATAAAGAAAGT
GATCACTACCCTTTGAATCATAAGACTAATTTCGACGAGGATCACCATGAAGATCTTAATTTCAAG
AACGTCTTGACCAGGAAGACCACGGCCGCGACCACCGAGAATCGCTACAATACAATCAACGAGAAC
GGTTATAGTAATAACAATGGCGTGATTAGGGTTTGTTCGGATTGTAACACCACCAAGACTCCTCTT
TGGCGAAGTGGACCTCGAGGTCCCAAGTCTCTTTGTAACGCATGTGGTATACGGCAAAGAAAGGCA
AGGCGAGCCGCTATGGCCGCGGCCGCTGCAGCCGGCGACCAAGAGGTGGCGGTAGCGCCCCGAGTG
CAACAATTACCGCTGAAAAGAATTTGCAAAATAAAAAAAAGAGATCAAACGGAGGGGAAAAATAC
AATCACTCTCCTCCAATGGTGGCCAAGGCCAAAAAGTGCAAGATCAAAGAGGAAGAGGAGAAGGAA
ATGGAAGCGGAAACGGTTGCCGGAGATTCAGAGATCAGCAAATCTACAACTTCTTCTAATTCTTCG
ATTTCGTCAAACAAATTTTGCTTCGATGATTTGACAATAATGTTGAGCAAAAGCTCAGCTTATCAA
CAAGTGTTCCCACAAGATGAGAAGGAGGCTGCTGTTTTGCTCATGGCTCTGTCGTATGGAATGGTT
CACGGTTGA

SEQ ID NO: 158, AAL38250.1| unknown protein [Arabidopsis thaliana]
MDSNFHYSIDLNEDQNHHEQPFFYPLGSSSSLHHHHHHHHQVPSNSSSSSSSISSLSSYLPFLIN
SQEDQHVAYNNTYHADHLHLSQPLKAKMFVANGGSSACDHMVPKKETRLKLTIRKKDHEDQPHPLH
QNPTKPDSDSDKWLMSPKMRLIKKTITNNKQLIDQTNNNNHKESDHYPLNHKTNFDEDHHEDLNFK
NVLTRKTTAATTENRYNTINENGYSNNNGVIRVCSDCNTTKTPLWRSGPRGPKSLCNACGIRQRKA
RRAAMAAAAAAGDQEVAVAPRVQQLPLKKNLQNKKKRSNGGEKYNHSPPMVAKAKKCKIKEEEEKE
MEAETVAGDSEISKSTTSSNSSISSNKFCFDDLTIMLSKSSAYQQVFPQDEKEAAVLLMALSYGMV
HG

SEQ ID NO: 159, AL161564 (gi|7269427:141673-141954, 142037-142414, 142724-143122) Arabidopsis thaliana DNA chromosome 4, contig fragment No. 64
ATGGGTTCCAATTTTCATTACACAATAGATCTCAATGAAGATCAAAACCATCAGCCTTTTTTCGCT
TCTCTTGGATCCTCTCTTCATCATCATCTACAACAACAACAACAACAACAACATTTTCATCAC
CAAGCTTCTTCTAATCCCTCTTCTTTGATGTCACCGTCTCTTTCCTACTTTCCTTTCTTGATAAAC
TCTCGCCAAGATCAAGTATATGTTGGGTACAACAATAACACTTTTCATGATGTTCTTGATACCCAT FIGURE 14 (continued)

```
ATCTCCCAACCTCTCGAGACCAAGAACTTTGTATCTGATGGTGGTTCATCATCAAGTGATCAAATG
GTGCCCAAGAAGGAGACACGACTAAAATTGACGATAAAGAAGAAAGATAATCATCAAGACCAAACC
GATCTTCCTCAATCCCCAATAAAAGACATGACAGGAACTAACTCGCTCAAGTGGATATCTTCGAAG
GTGAGATTAATGAAGAAGAAAAAGGCGATTATTACCACCAGCGACAGCAGCAAACAACACACTAAT
AACGACCAATCCTCAAACCTAAGCAATTCGGAAAGACAGAATGGTTATAACAACGATTGCGTGATT
AGGATTTGCTCCGATTGTAACACAACCAAGACTCCTCTTTGGAGAAGTGGTCCGAGAGGTCCCAAG
TCTCTTTGTAACGCTTGTGGAATAAGGCAAAGGAAGGCCAGGCGGGCCGCTATGGCCACGGCAACC
GCAACCGCAGTCTCTGGCGTATCCCCACCGGTCATGAAGAAGAAGATGCAAAACAAGAACAAGATA
TCAAATGGAGTTTATAAAATCTTATCTCCTTTGCCCCTAAAGGTAAACACGTGTAAGAGAATGATC
ACACTAGAGGAGACCGCATTAGCCGAGGATTTGGAGACCCAGAGCAACTCCACGATGTTATCATCT
TCAGACAATATCTATTTCGATGATCTAGCATTACTGTTGAGCAAAAGTTCAGCTTATCAGCAAGTT
TTCCCTCAAGATGAGAAGGAGGCTGCCATTTTACTAATGGCTCTATCGCACGGAATGGTTCACGGG
TGA
```

SEQ ID NO: 160, CAB79470.1| putative GATA transcription factor [Arabidopsis thaliana]
MGSNFHYTIDLNEDQNHQPFFASLGSSLHHHLQQQQQQQQHFHHQASSNPSSLMSPSLSYFPFLIN
SRQDQVYVGYNNNTFHDVLDTHISQPLETKNFVSDGGSSSSDQMVPKKETRLKLTIKKKDNHQDQT
DLPQSPIKDMTGTNSLKWISSKVRLMKKKKAIITTSDSSKQHTNNDQSSNLSNSERQNGYNNDCVI
RICSDCNTTKTPLWRSGPRGPKSLCNACGIRQRKARRAAMATATATAVSGVSPPVMKKKMQNKNKI
SNGVYKILSPLPLKVNTCKRMITLEETALAEDLETQSNSTMLSSSDNIYFDDLALLLSKSSAYQQV
FPQDEKEAAILLMALSHGMVHG

SEQ ID NO: 161, AM444649, (gi|123652736:c12747-12451, c12344-12006) Vitis vinifera contig VV78X242028.10, whole genome shotgun sequence
```
ATGGCGGATGACAATAAGAGCAGCCACAAATTRTCGGTTTTTAAGAAGGAAGAAGGAGATGAAGGT
AATAAAAGTACTGAGAAATGGATGTCTTCAAAGATGAGGCTGATGAGAAAAATGATGAACTCGGAT
TGCACTACAGCGAAAATCGAGCAGAAGGTTGAAGATCATCAGCAGTGGGACAATATTAAYGAGWTC
AACTCTTCCAACAATACTAGTAATATCCCAATTAGAGTCTGCAGTGATTGTAACACAACCAAAACC
CCTCTTTGGAGGAGYGGTCCTAGAGGTCCCAAGTCACTTTGCAATGCCTGTGGAATTAGGCAAAGG
AAGGCGAGACGAGCCATGGCAGCAGCGGCAGCAGCAGCAGCGAATGGCACAGCCGTTGGGACCGAG
ATATCGCCTATGAAGATGAAGCTGCCCAACAAGGAAAAGAAGATGCATACAAGCAATGTAGGGCAA
CAGAAGAAGCTCTGCAAGCCCCCTTGTCCTCCTCCCACCGAGAAGAAGCTTTGCTTCGAAGATTTC
ACTTCGAGTATTTGCAAGAACTCAGGTTTTAGACGAGTGTTCCCTCGGGATGAAGAAGAAGCCGCG
ATCCTCCTAATGGCCTTATCTTGTGACCTTGTTTACAGTTGA
```

SEQ ID NO: 162, CAN63090.1| hypothetical protein [Vitis vinifera]
MADDNKSSHKLSVFKKEEGDEGNKSTEKWMSSKMRLMRKMMNSDCTTAKIEQKVEDHQQWDNINEX
NSSNNTSNIPIRVCSDCNTTKTPLWRSGPRGPKSLCNACGIRQRKARRAMAAAAAAANGTAVGTE
ISPMKMKLPNKEKKMHTSNVGQQKKLCKPPCPPPTEKKLCFEDFTSSICKNSGFRRVFPRDEEEAA
ILLMALSCDLVYS

FIGURE 14 (continued)

SEQ ID NO: 163, CU459230, (gi|157342443:1796153-1796356, 1796443-1796784) Vitis vinifera chromosome chr11 scaffold_13, whole genome shotgun sequence
ATGATCTCGGATCAAACTGGTGCCCAAAAACCAAGCAACACTGCACTCAATTTTGGAGATCACAAG
CAGCAATCCTTGCCTTCTGAAACCGATTACAATAGCATCAATTCCTCTAATATCAACAGCAACAAC
ACAATTAGGGTTTGTGCAGATTGTAACACAACTAAGACCCCTCTGTGGAGGAGTGGCCCAAGAGGC
CCTAAGTCTCTCTGCAACGCCTGCGGAATCAGGCAAAGGAAGGCTAGACGGGCCATGGCTGCTGCT
GCTGCAACTGCTAATGGCACAATTCTTCCAACCAACACAGCACCCACAAAGACCAAGGCCAAGCAC
AAAGACAAGAAGTCGAGCAATGGTCATGTTTCACACTACAAGAAACGGTGCAAACTGGCTGCGGCC
CCATCTTGTGAAACAAAGAAGCTTTGTTTCGAGGACTTCACCATAAGCTTGAGTAAGAATTCCGCT
TTCCACCGAGTTTTCCTCCAAGACGAGATCAAGGAAGCGGCGATCCTGCTAATGGCTCTATCTTGC
GGCCTCGTCCATGGTTGA

SEQ ID NO: 164, CAO65359.1| unnamed protein product [Vitis vinifera]
MISDQTGAQKPSNTALNFGDHKQQSLPSETDYNSINSSNINSNNTIRVCADCNTTKTPLWRSGPRG
PKSLCNACGIRQRKARRAMAAAAATANGTILPTNTAPTKTKAKHKDKKSSNGHVSHYKKRCKLAAA
PSCETKKLCFEDFTISLSKNSAFHRVFLQDEIKEAAILLMALSCGLVHG

SEQ ID NO: 165, ABK32152, Arabidopsis thaliana (thale cress) At5g49300
ATGCTAGATCACAGTGAAAAGGTCTTATTGGTTGATTCAGAAACCATGAAAACAAGAGCTGAAGAT
ATGATCGAACAGAACAACACTAGTGTTAACGACAAGAAGAAGACTTGTGCTGATTGTGGAACCAGT
AAAACTCCTCTTTGGCGTGGTGGTCCTGTTGGTCCAAAGTCGTTGTGTAACGCGTGTGGGATCAGA
AACAGAAAGAAGAGAAGAGGAGGAACAGAAGATAATAAGAAATTAAAGAAATCGAGTTCTGGCGGC
GGAAACCGTAAATTTGGTGAATCGTTAAAACAGAGTTTGATGGATTTGGGGATAAGGAAGAGATCA
ACGGTGGAGAAGCAACGACAGAAGCTTGGTGAAGAAGAACAAGCCGCTGTGTTACTCATGGCTCTT
TCTTATGGCTCTGTTTACGCTTAG

SEQ ID NO: 166, A0JPW8 ARATH|A0JPW8 name|At5g49300, Putative GATA transcription factor 23, Arabidopsis thaliana
MLDHSEKVLLVDSETMKTRAEDMIEQNNTSVNDKKKTCADCGTSKTPLWRGGPVGPKSLCNACGIR
NRKKRRGGTEDNKKLKKSSSGGGNRKFGESLKQSLMDLGIRKRSTVEKQRQKLGEEEQAAVLLMAL
SYGSVYA

SEQ ID NO: 167, CU459281, (gi|157352894:c742499-742374, c742280-742225, c742185-742071, c742049-741984) Vitis vinifera chromosome chr5 scaffold_64, whole genome shotgun sequence
ATGAACAACAAAAACCCAGATGCTGTTTCGTCGGCTGAGAGCCAGGTTAACGAGCCGAAGAAGACC
TGCGCTGATTGTGGCACCACCAAAACCCCTCTCTGGAGAGGCGGTCCAGCTGGGCCTAAGTCTCTG
TGCAATGCATGTGGTATCAGAAGCAGGAAGAAGAGAAGAGCCTTCCTGGGAAGCAGCAACCACTCC
CATAACAATGGTGGCGGCAACGGGAACAATAAATTGGGGACTCGCTGAAGAGGAGGCTCTTCGCA
TTGGGAAGAGAGGTGTTGTTGCAGAGATCAACACTGGGAGAAGAAGAGCAAGCGGCCGTACTGTTA
ATGGCTCTGTCTTACGGCTACGTCTATGCTTAA

SEQ ID NO: 168, CAO44870.1 unnamed protein product [Vitis vinifera]
MNNKNPDAVSSAESQVNEPKKTCADCGTTKTPLWRGGPAGPKSLCNACGIRSRKKRRAFLGSSNHS
HNNGGGNGNNKLGDSLKRRLFALGREVLLQRSTLGEEEQAAVLLMALSYGYVYA

FIGURE 14 (continued)

SEQ ID NO: 169, CAN74414, Vitis vinifera hypothetical protein
ATGATGGATCTGAGCAAAAAGGAATCATTGTCTGAGGAAATGAATGAGATCAAGAAATGTTGTACT
GATTGCAAGACCACCAAGACGCCCCTGTGGAGAGGTGGGCCAGCTGGGCCTAAGTCACTCTGCAAT
GCATGTGGGATCAGATACAGGAAGAGGAGGAGTTCCATGGTGGGTGTGAACAAAAAGAAAGAGAGA
ATGAACAGTGGTAGCCATGATTTGAGTGAAACTTTGAAGCAGTCACTCATGGCTTTGGGGAATGAG
GTGATGATGCAGAGGCAGAGATCTTCAGTGAAGAAACAGAGGAGGAAGTTGGGGGAAGAAGAACAA
GCAGCTGTACTGTTGATGGCACTCTCATGTGGCTCTGTTTTTGCCTAG

SEQ ID NO: 170, A5BCR3 VITVI|A5BCR3 name|Putative uncharacterized protein Vitis vinifera
MMDLSKKESLSEEMNEIKKCCTDCKTTKTPLWRGGPAGPKSLCNACGIRYRKRRSSMVGVNKKKER
MNSGSHDLSETLKQSLMALGNEVMMQRQRSSVKKQRRKLGEEEQAAVLLMALSCGSVFA

SEQ ID NO: 171, EAY92433, Oryza sativa (indica cultivar-group) hypothetical protein
ATGGATTCCTCGTCGGTCGAGAAGGGGAGTGGGTCGATAGATCCGGACGAGCGCACGGCCTCCGGC
GAGCCCAAGGCGTGCACCGACTGCCACACCACCAAGACTCCGCTCTGGCGCGGCGGCCCCTCCGGC
CCCAAGTCGCTATGCAACGCGTGCGGGATCCGGTACCGGAAGAAGAGACGGGAGGCGCTGGGGCTC
GACGCCGGCGAGGGCGGCGCGGAGCGGCAGGAGAAGAAGAAGAGCAAGAGGGAGAGAGGGGAGGAG
GTGACCATGGAGCTCCGCATGGTGGGGTTCGGGAAGGAGGTGGTCCTGAAGCAGCGGCGGCGGATG
CGGCGGAGGAGACGCCTCGGCGAGGAGGAGAAGGCGGCCATCCTCCTCATGGCCCTCTCCTCCGGA
GTCATCTACGCCTGA

SEQ ID NO: 172, A2XNM3 ORYSI|A2XNM3 name| expressed protein Os03g0831200 [Oryza sativa (japonica cultivar-group)]
MDSSSVEKGSGSIDPDERTASGEPKACTDCHTTKTPLWRGGPSGPKSLCNACGIRYRKKRREALGL
DAGEGGAERQEKKKSKRERGEEVTMELRMVGFGKEVVLKQRRRMRRRRRLGEEEKAAILLMALSSG
VIYA

SEQ ID NO: 173, BAD87039, Oryza sativa (japonica cultivar-group) zinc finger protein-like
ATGGATATGGATTCTTCCTCCTCCCCGGTGGACAAGGTGGATCCCGACGAGTGCAACGGCTCTAAG
GCTTGCGCTGACTGCCACACTACCAAGACTCCGCTATGGCGAGGCGGACCCGGAGGACCCAAGTCG
CTGTGCAACGCATGCGGGATCCGGTATCGGAAGAGGCGGCGGGCGGCGCTCGGCCTGGACTCTTCC
GCCACCGCCACCGCCACCGACGGAGCGGAGCAGCAGAAGAAGACTAAGGCCAAGAAGGAAAAGGCA
CAGGAGGAGGAGGTCACCATGGAGCTCCACACGGTGGGCTTCCGCAGCAAGGACGCTGCTGTGTTC
AAGCAGCGCCGGCGGATGCGCCGCAGGAAATGCCTTGGCGAGGAGGAGAGGGCCGCCATCCTGCTC
ATGGCACTCTCCTCGGGCGTCATCTACGCCTGA

SEQ ID NO: 174, Q5JNB8 ORYSJ|Q5JNB8 name|Zinc finger protein-like Oryza sativa (japonica cultivar-group)
MDMDSSSPVDKVDPDECNGSKACADCHTTKTPLWRGGPGGPKSLCNACGIRYRKRRRAALGLDSS
ATATATDGAEQQKKTKAKKEKAQEEEVTMELHTVGFRSKDAAVFKQRRRMRRRKCLGEEERAAILL
MALSSGVIYA

FIGURE 14 (continued)

SEQ ID NO: 175, AAM63797, Arabidopsis thaliana (thale cress) transcription factor-like protein
ATGCAGACTCCGTACACTACTTCAACGCAGGGGCAATATTGTCATTCTTGTGGAATGTTCCACCAC
CATAGCCAAAGCTGCTGCTACAACAACAACAACAACTCCAACGCCGGTTCTTACTCGATGGTCTTC
TCCATGCAAAACGGTGGCGTTTTCGAGCAGAACGGTGAGGACTATCATCACTCTTCCTCCCTCGTT
GACTGCACTCTCTCTCTTGGAACTCCTTCTACGAGGCTTTGTGAGGAAGATGAGAAACGTAGACGC
TCTACTTCATCTGGTGCTTCTTCTTGCATCTCCAACTTTTGGGACTTGATTCACACCAAAAACAAC
AACTCCAAAACGGCACCGTACAATAACGTTCCTTCTTTCTCCGCTAACAAGCCAAGTCGCGGTTGT
TCCGGTGGTGGTGATGGCGGAGGAGGCGGTGGCGGAGGTGACTCTCTTCTCGCTAGACGCTGTGCC
AACTGTGACACTACTTCTACTCCACTATGGAGGAATGGTCCTAGAGGCCCTAAGTCCCTATGCAAC
GCATGCGGCATTCGTTTCAAGAAGGAAGAGAGAAGAACTACTGCGGCTTCAGGAAACACCGTCGTC
GGAGCTGCACCGGTTCAAACCGACCAGTACGGGCATCACAACTCTGGCTACAATAATTACCATGCT
GCCACTAATAACAACAATAATAATGGTACTCCGTGGGCTCATCACCACTCGACGCAGAGGGTTCCG
TGTAATTATCCGGCAAATGAGATCAGGTTCATGGATGATTACGGCAGTGGAGTAGCAAACAACGTT
GAATCCGACGGTGCTCACGGCGGTGTTCCGTTCCTTTCTTGGAGGCTTAATGTAGCGGATAGGGCA
AGTCTTGTCCATGACTTTACCAGATGA

SEQ ID NO: 176, Q8LC79, genpept|71660804, GATA transcription factor 19, Arabidopsis thaliana
MMQTPYTTSTQGQYCHSCGMFHHHSQSCCYNNNNNSNAGSYSMVFSMQNGGVFEQNGEDYHHSSSL
VDCTLSLGTPSTRLCEEDEKRRRSTSSGASSCISNFWDLIHTKNNNSKTAPYNNVPSFSANKPSRG
CSGGGGGGGGGGGGDSLLARRCANCDTTSTPLWRNGPRGPKSLCNACGIRFKKEERRTTAATGNTV
VGAAPVQTDQYGHHNSGYNNYHAATNNNNNNGTPWAHHHSTQRVPCNYPANEIRFMDDYGSGVANN
VESDGAHGGVPFLSWRLNVADRASLVHDFTR

SEQ ID NO: 177, OsGATA3-like, Oryza sativa
ATGCTTCACCATTACTACAGCGGCGGCGCCGGCCATCATCAGGACGTCGCTGCAGCTGGTAGCCCC
GGCGACATGGCTTCCTCCACCTTCTCGCTCTTCTTCCCGATGTCCAATGGGCAGTGTTGGCCGCCG
TCGACGGTGGAGGAGTCCGCGGCCTACGACGACCACAGCACCGTCACCACCTCTCCTTCCTCGCCT
TCGTCGTCCTCCACCGGCTCCGTCGACTGCACGCTCTCGCTCGGCACGCCGTCGTCTCGCCGCGCC
GAGCCCGTCGCGGCGGCGGCGCCAGCGGCAAACCATGGGGCGCCCGTGCCGGCGCATTATCCGTCG
CTGTCAGCGGCGACCGTGTCCTGGGACGCGACTGCCGAGTCGTACTATTGTGGCCAGCAGGGGAGG
CCGGCCACCGGCGCCGCCAAGTGCGCCGCCGGCGCCGGGCACGACGCGCTCCTCGACCGCCGCTGC
GCCAACTGCGGCACCGCGTCCACGCCGCTCTGGAGGAACGGCCCTCGCGGACCCAAGTCGCTGTGC
AACGCGTGCGGGATCAGGTACAAGAAGGAGGAGCGGCGCGCGGCGGCGACGACGACGACGGCCGAC
GGCGCCGCCGGATGCGGCTTCATCACCGCGCAGCGTGGACGCGGTCGACCGCGGCCAAGGCGGCG
CCCGCCGTGACGACGTGCGGCGAGGAGACGTCACCGTACGTCGTCGGCGGCGGCGGCGGCGGCGGC
GAGGTCGCGGACGCGGCGTATCTCGCCTGGCGGCTCAACGTCGTCCCACCGGCGGCGACGGCGACG
GCGTTCTCGGTGTGGCCGGAGCGAGCTAGCCTCTACCACTACAACTAG

SEQ ID NO: 178, OsGATA3-like, Oryza sativa
MLHHYYSGGAGHHQDVAAAGSPGDMASSTFSLFFPMSNGQCWPPSTVEESAAYDDHSTVTTSPSSP
SSSSTGSVDCTLSLGTPSSRRAEPVAAAAPAANHGAPVPAHYPSLSAATVSWDATAESYYCGQQGR
PATGAAKCAAGAGHDALLDRRCANCGTASTPLWRNGPRGPKSLCNACGIRYKKEERRAAATTTTAD
GAAGCGFITAQRGRGSTAAKAAPAVTTCGEETSPYVVGGGGGGGEVADAAYLAWRLNVVPPAATAT
AFSVWPERASLYHYN

FIGURE 14 (continued)

SEQ ID NO: 179, prm10106
GGGGACAAGTTTGTACAAAAAAGCAGGCTTAAACAATGCTTCACCATTACTACAGC

SEQ ID NO: 180, prm10107
GGGGACCACTTTGTACAAGAAAGCTGGGTCCAACGCTAATGCTACACT

FIGURE 14 (continued)

MGRSKLASRPAEEDLNPGKSKRKKISLGPENAAASISTGIEAG

NERKPGLYCCNYCDKDLSGLVRFKCAVCMDFDLCVECFSVGVE

LNRHKNSHPYRVMDNLSFSL<u>VTSDWNADEEILLLEAIATYGFG</u>

<u>NWKEVADHVGSKTTTECIKHFNSAYM</u>QSPCFPLPDLSHTIGKS

KDELLAMSKDSAVKTEIPAFVRLSPKEELPVSAEIKHEASGKV

NEIDPPLSALAGVKKKGNVPQAKDIIKLEAAKQQSDRSVGEKK

LRLPGEKVPLVTELYGYNLKREEFEIEH*DNDAEQLLADMEF*KD

SDTDAEREQKLQVLRIYSKRLDERKRRKEFVLERNLLYPDQYE

MSLSAEERKIYKSCKVFARFQSKEEHKELIKKVIEEHQILRRI

EDLQEARTAGCRTTSDANRFIEEKRKKEAEESMLLRLNHGAPG

SIAGKTLKSPRGLPRNLHPFGSDSLPKVTP<u>PRIYSGLDTWDVD</u>

<u>GLLGADLLSETEKKMCNETRILPVHYLKMLDILTREIKKGQIK</u>

<u>KKSDAYSFFKVEPSKVDRVYDMLVHKGIGDST</u>

FIGURE 15

```
                         1                                                50
Arath_ADA2_1     (1)   --------------------------------------------------
Dicdi_ADA2_1     (1)   MTSTINKEEPTTLVNKKRRKEHVDDDDDNDDDIEMQNVSNDNINNTDDEN
Ostlu_ADA2_1     (1)   --------------------------------------------------
Arath_ADA2_2     (1)   --------------------------------------------------
Poptr_ADA2_1     (1)   --------------------------------------------------
Poptr_ADA2_3     (1)   --------------------------------------------------
Lyces_ADA2_2     (1)   --------------------------------------------------
Orysa_ADA2_1     (1)   --------------------------------------------------
Zeama_ADA2_1     (1)   --------------------------------------------------
Zeama_ADA2_2     (1)   --------------------------------------------------
Lyces_ADA2_1     (1)   --------------------------------------------------
Poptr_ADA2_2     (1)   --------------------------------------------------
Vitvi_ADA2_1     (1)   --------------------------------------------------
   Consensus     (1)

51                                               100
Arath_ADA2_1     (1)   --------------------------------------------------
Dicdi_ADA2_1    (51)   NNVNTNGNNTNKTNNNNNNNNNNNNNNNNEEDDDEEDLLITKRRNSRSTTM
Ostlu_ADA2_1     (1)   --------------------------------------------------
Arath_ADA2_2     (1)   --------------------------------------------------
Poptr_ADA2_1     (1)   --------------------------------------------------
Poptr_ADA2_3     (1)   --------------------------------------------------
Lyces_ADA2_2     (1)   --------------------------------------------------
Orysa_ADA2_1     (1)   --------------------------------------------------
Zeama_ADA2_1     (1)   --------------------------------------------------
Zeama_ADA2_2     (1)   --------------------------------------------------
Lyces_ADA2_1     (1)   --------------------------------------------------
Poptr_ADA2_2     (1)   --------------------------------------------------
Vitvi_ADA2_1     (1)   --------------------------------------------------
   Consensus    (51)

101                                              150
Arath_ADA2_1     (1)   --------------------------------------------------
Dicdi_ADA2_1   (101)   SNNSSNKSTPSKKKRIKKSYDNDKDFVGDDEEEDDNDDEDDDGDVVISNN
Ostlu_ADA2_1     (1)   --------------------------------------------------
Arath_ADA2_2     (1)   --------------------------------------------------
Poptr_ADA2_1     (1)   --------------------------------------------------
Poptr_ADA2_3     (1)   --------------------------------------------------
Lyces_ADA2_2     (1)   --------------------------------------------------
Orysa_ADA2_1     (1)   --------------------------------------------------
Zeama_ADA2_1     (1)   --------------------------------------------------
Zeama_ADA2_2     (1)   --------------------------------------------------
Lyces_ADA2_1     (1)   --------------------------------------------------
Poptr_ADA2_2     (1)   --------------------------------------------------
Vitvi_ADA2_1     (1)   --------------------------------------------------
   Consensus   (101)
```

FIGURE 16

```
                        151                                              200
Arath_ADA2_1      (1)   --------------------------------------------------
Dicdi_ADA2_1    (151)   NNNNNNNNNTNNNNNNNNNGNGNGNNNTNNSFEEDDDEEDDDEEDEEEEEG
Ostlu_ADA2_1      (1)   --------------------------------------------------
Arath_ADA2_2      (1)   --------------------------------------------------
Poptr_ADA2_1      (1)   --------------------------------------------------
Poptr_ADA2_3      (1)   --------------------------------------------------
Lyces_ADA2_2      (1)   --------------------------------------------------
Orysa_ADA2_1      (1)   --------------------------------------------------
Zeama_ADA2_1      (1)   --------------------------------------------------
Zeama_ADA2_2      (1)   --------------------------------------------------
Lyces_ADA2_1      (1)   --------------------------------------------------
Poptr_ADA2_2      (1)   --------------------------------------------------
Vitvi_ADA2_1      (1)   --------------------------------------------------
   Consensus    (151)

201                                              250
Arath_ADA2_1      (1)   --------------------------------------------------
Dicdi_ADA2_1    (201)   MKISKSKRQTQIIPPTQSEVDDLVNKSFNSVDDDEEDNEEDDKTKNTTTT
Ostlu_ADA2_1      (1)   --------------------------------------------------
Arath_ADA2_2      (1)   --------------------------------------------------
Poptr_ADA2_1      (1)   --------------------------------------------------
Poptr_ADA2_3      (1)   --------------------------------------------------
Lyces_ADA2_2      (1)   --------------------------------------------------
Orysa_ADA2_1      (1)   --------------------------------------------------
Zeama_ADA2_1      (1)   --------------------------------------------------
Zeama_ADA2_2      (1)   --------------------------------------------------
Lyces_ADA2_1      (1)   --------------------------------------------------
Poptr_ADA2_2      (1)   --------------------------------------------------
Vitvi_ADA2_1      (1)   --------------------------------------------------
   Consensus    (201)

251                                              300
Arath_ADA2_1      (1)   --------------------------------------------------
Dicdi_ADA2_1    (251)   TATNTTNVPTTTTTTTTTSNNTTLPTTTTTTTTNNTTKPNVKIEQPKTQQ
Ostlu_ADA2_1      (1)   --------------------------------------------------
Arath_ADA2_2      (1)   --------------------------------------------------
Poptr_ADA2_1      (1)   --------------------------------------------------
Poptr_ADA2_3      (1)   --------------------------------------------------
Lyces_ADA2_2      (1)   --------------------------------------------------
Orysa_ADA2_1      (1)   --------------------------------------------------
Zeama_ADA2_1      (1)   --------------------------------------------------
Zeama_ADA2_2      (1)   --------------------------------------------------
Lyces_ADA2_1      (1)   --------------------------------------------------
Poptr_ADA2_2      (1)   --------------------------------------------------
Vitvi_ADA2_1      (1)   --------------------------------------------------
   Consensus    (251)
```

FIGURE 16 (continued)

```
                    301                                                  350
Arath_ADA2_1    (1) --------------------MGRSK--------LASRPAEEDLNPGKSK
Dicdi_ADA2_1  (301) PPQPQPINKPTQSNTITTNTNTSTNTNTATNTNSNTATATTTSPTSMTKQ
Ostlu_ADA2_1    (1) --------------------------------------------MASALV
Arath_ADA2_2    (1) --------------------MGRSR--------GNFQN-FEDP-TQRTR
Poptr_ADA2_1    (1) --------------------MGRSR--------GNFHSNDEDP-TQRSR
Poptr_ADA2_3    (1) --------------------MGRSR--------GNFHSTDEDP-TQRSR
Lyces_ADA2_2    (1) --------------------MGRSR--------GNFQA-DEDP-SQRSR
Orysa_ADA2_1    (1) --------------------MGRSR--------GVPNS-GDDETNHRSK
Zeama_ADA2_1    (1) --------------------MGRSR--------GVQNS-GDDDTVHRSK
Zeama_ADA2_2    (1) --------------------MGRSR--------GVLSS-GDDDTGHRSK
Lyces_ADA2_1    (1) --------------------MGRSR--------AVHQSTDDDP-SQRSK
Poptr_ADA2_2    (1) --------------------MGRSRGRPPSSGTSTAAAASDDPNNRSSK
Vitvi_ADA2_1    (1) --------------------MGRSR--------AVLHSTDDDQGSHRSK
   Consensus  (301)                      MGRSR        G     S  DDP S RSK 351                                                  400
Arath_ADA2_1   (22) RKKISLGPEN-AAASISTGIEA---GNERKPGLYCCNYCDKDLSGLVRFK
Dicdi_ADA2_1  (351) TRKSTNSPTNSNGNNNNNNNNNNFIEEQVNEGLYHCDYCQKDISGVVRIR
Ostlu_ADA2_1    (7) PKRRRVATENAMTKLSGNGES---------CALFNCNYCQKDISNVVRVR
Arath_ADA2_2   (20) KKKNAANVENFESTSLVPGAEG------GG--KYNCDYCQKDITGKIRIK
Poptr_ADA2_1   (21) RKKNAASGDNSESLLAGQGSGD------GKRALYHCNYCNKDITGKTRIK
Poptr_ADA2_3   (21) RKKNAASGENSESSSAGQGSSD------GKRALYHCNYCNKDITGKTRIK
Lyces_ADA2_2   (20) RKKNASSVDNLESATTGQGTAD------GKRALYHCNYCNKDISGRTRIK
Orysa_ADA2_1   (21) RRRVASSGDAPDSLSAACGGAG---EGGGKKALYHCNYCNKDISGKIRIK
Zeama_ADA2_1   (21) RRRVASGGDATDSVSAGIGGAG---EGGGKKALYHCNYCNKDISGKIRIK
Zeama_ADA2_2   (21) RRRVSSGGDATDSISASIGGAG---EGGGKKALYHCNYCNKDISGKIRIK
Lyces_ADA2_1   (21) RKRAVPNVESFDTAATGQILTE------GKKALYHCNYCNKDISGRIRIK
Poptr_ADA2_2   (30) RKKTTSNVGSIETAFPAVYQEK---G-QGKLALYHCNYCHKDISGMVRIK
Vitvi_ADA2_1   (22) RRKTASTADNLEGATAGQGMS------EGKRASYHCNYCSKDISGKIRTK
   Consensus  (351) RKK AS   DN ES SAGQG A        GKKALYHCNYCNKDISGKIRIK 401                                                  450
Arath_ADA2_1   (68) CAVCMDFDLCVECFSVGVELNRHKNSHPYRVMDNLSFSLVTSDWNADEEI
Dicdi_ADA2_1  (401) CSVCTDFDLCLECFSVGVEITPHRNFHDYHVVDNMHFPMFTDDWGADEEL
Ostlu_ADA2_1   (48) CAECANVDLCTECFAVGVEPHPHKAYHQYHVIDNMSFPLFTRDWGADEEL
Arath_ADA2_2   (62) CAVCPDFDLCIECMSVGAEITPHKCDHPYRVMGNLTFPLICPDWSADDEM
Poptr_ADA2_1   (65) CAMCPDFDLCLECFSVGAEVTPHKSNHPYRVMDNLSFPLICPDWNADEEI
Poptr_ADA2_3   (65) CAVCPDFDLCLECFSVGAEVTPHKSNHPYRVMDNLSFPLICPDWNADEEI
Lyces_ADA2_2   (64) CAVCYDFDLCIECFSVGAEVHPHKSHHYRVMDILAFPLICPDWNADEEM
Orysa_ADA2_1   (68) CSKCPDFDLCVECFSVGAEVTPHRSNHPYRVMDNLSFPLICPDWNADEEI
Zeama_ADA2_1   (68) CSKCPDFDLCVECFSVGAEVTPHRSNHPYKVMDNLSFPLICPDWNADEEI
Zeama_ADA2_2   (68) CSKCPDFDLCVECFSVGAEVTPHRSNHPYKVMDNLSFPLICPDWNADEEI
Lyces_ADA2_1   (65) CVVCSDFDLCVECFSVGAEVQPHKSNHLYRVMDNLSFPLICADWNADEEM
Poptr_ADA2_2   (76) CAVCPDFDLCVECFSVGAEVTPHKSNHPYRVMDNLSFPLFHPDWNTDEEI
Vitvi_ADA2_1   (66) CVVCPDFDLCIECFSIGAEVTPHVCFHPYRVMDNLSFPLICPDWNADEEM
   Consensus  (401) CAVCPDFDLCVECFSVGAEVTPHKSNHPYRVMDNLSFPLICPDWNADEEI
```

FIGURE 16 (continued)

```
                       451                                                500
Arath_ADA2_1    (118)  LLLEAIATYGFGNWKEVADHVGSKTTT--ECIKHFNSAYMQSPCFPLPDL
Dicdi_ADA2_1    (451)  LLLEAIELYGLGNWNEVSENVGAHSKSPLECKAHYFAHYLNSSTSPLPDT
Ostlu_ADA2_1     (98)  LLLEAVEMFGLGNWTEVSEHVGTKTRA--QCHAHYFEVYVKSPCAPLPDM
Arath_ADA2_2    (112)  LLLEGLEIYGLGNWAEVAEHVGTKSKE--QCLEHYRNIYLNSPFFPLPDM
Poptr_ADA2_1    (115)  LLLEGIEMYGLGNWAEIAEHVGTKSKD--TCIEHYNSVYMQSQYFPLPDM
Poptr_ADA2_3    (115)  LLLEGIEMYGLGNWAEVAEHVGTKNKE--TCIKHYNSVYLQSQFFPLPDM
Lyces_ADA2_2    (114)  LLLEGIEMYGMGNWAEVGEHVGTKTKE--ACIDHFKDAYLKSPYFPLPDM
Orysa_ADA2_1    (118)  LLLEGIEMYGLGNWAEVAEHVGTKTKA--QCIDHYTTAYMNSPCYPLPDM
Zeama_ADA2_1    (118)  LLLEGIEMYGLGNWLEVAEHVGTKSKL--QCIDHYTTAYMNSPCYPLPDM
Zeama_ADA2_2    (118)  LLLEGIEMYGLGNWLEVAEHVGTKSKL--QCIDHYTSAYMNSPCYPLPDM
Lyces_ADA2_1    (115)  LLLEGLEMYGLANWAEVAEHVGTKSKQ--QCIDHYKSTYISSPCFPLPDM
Poptr_ADA2_2    (126)  LLLEGIEMYGFGNWTEVSEHAGTKSKS--QCIDHYNAVYMDSPCFPLPDM
Vitvi_ADA2_1    (116)  LLLEGIEMYGLGNWSEVSEHVGTKRKS--ECIDHYVAIYMNSPCFPLPDM
   Consensus    (451)  LLLEGIEMYGLGNWAEVAEHVGTKSK   QCIDHY S YMNSPCFPLPDM 501                                                550
Arath_ADA2_1    (166)  SHTIGKSKDELLAMSKDSAVKTEIP--AFVRLSPKEELPVSAEIKHEASG
Dicdi_ADA2_1    (501)  SKVLTTNENVHFKRAKTTVNGNYYNDYIIDNSDDDDNNNNNNN-YNDNSN
Ostlu_ADA2_1    (146)  SKILGKG---VARMTS-------------DELKAEAEQKANENKDVEEE-
Arath_ADA2_2    (160)  SHVAGKNRKELQAMAKGRIDDKK------AEQNMKEEYPFSPPKVKVEDT
Poptr_ADA2_1    (163)  SLVVGKNRKELLAMAKGYSEDKKGA-AMLGDLTLKEESPFSPSRVKVEEM
Poptr_ADA2_3    (163)  SHVVGKNRKELLAMAKGHSEDKKGT-SMLGEHTLKEESPFSPSRVKVEEM
Lyces_ADA2_2    (162)  THVMGKNRMELLAMAKGNFTDKKGL-SSLGDVAPKDES-FSPSRIKVEDT
Orysa_ADA2_1    (166)  SHVNGKNRKELLAMAKVQGESKK---VLPGDLTPKDESPFSPPRVKVEDA
Zeama_ADA2_1    (166)  SHVNGKNRKELLAMAKVQGESKKGTSLLPGELTPKAESPFSPSRVKVEDA
Zeama_ADA2_2    (166)  SHVNGKNRKELLAMAKVQGESKKGTLLLPGELTPKVESQFSPSRVKVEDA
Lyces_ADA2_1    (163)  SHVMGKNREELLAMAKDQGYAAP------GGVNVKEESPFSAGIKMEDQR
Poptr_ADA2_2    (174)  SHVMGKTREELLAMAR------------GNVEMKKEVSSHMG-------
Vitvi_ADA2_1    (164)  SHVLGKTRAELLAMAR------------GEDEVKKGSPTHGELTLKVES
   Consensus    (501)  SHVLGKNR ELLAMAK       KK       GEL  KEESPFSP RVKVED 551                                                600
Arath_ADA2_1    (214)  KVN----------------------EIDPPLSALAGVKKKGNVPQAKD
Dicdi_ADA2_1    (550)  N------------------------TTPTKSFNSVNK----------
Ostlu_ADA2_1    (179)  ------------------------------------------------
Arath_ADA2_2    (204)  QK----------------------------------------------
Poptr_ADA2_1    (212)  HKGGSSGR------LSTLNSEVESAGRPTTTNSAATAANKKASSIARVKD
Poptr_ADA2_3    (212)  HKVGSSGR------LSTLNSELETASRPNSANSAATAANKKASSMARIND
Lyces_ADA2_2    (210)  HKIGPSG-------------------RLTSVSNAGITGIKKPSSKTLIKD
Orysa_ADA2_1    (213)  LGEGLAG--------------------RSPSHIAGGANKKASNVGQFKD
Zeama_ADA2_1    (216)  LGEGLAG--------------------RSPSHIAVGANKKASNVGHIKD
Zeama_ADA2_2    (216)  LGEGPAG--------------------RSPSHMAVGANKKASNVGHIKD
Lyces_ADA2_1    (207)  EENS---------------TGLASVGGSASGTLAGAGKRTSSLLHSKE
Poptr_ADA2_2    (204)  --------------------------SSSGNTFSDAVKKASNEAQIKD
Vitvi_ADA2_1    (201)  PLSARVKYGKCMLKCVSLICQRSNPTWISSSTKTSAGAVKRASNMAQVKD
   Consensus    (551)          G                       S  S   A GA KKAS VA IKD
```

FIGURE 16 (continued)

```
                          601                                                650
Arath_ADA2_1       (240)  -IIKLEAAKQQSDRSVGEKKLRLPGEKVPLVTELYGYNLKREEFEIEHDN
Dicdi_ADA2_1       (563)  -----------SKKLNHRNSHGEEGPSGPVTDSVGYMKNRGHFEVEYDN
Ostlu_ADA2_1       (179)  -----------E-KLLESLANPNAVKTEGNVQELTGYNIKRNEFDPEYDM
Arath_ADA2_2       (206)  --------ESFVDRSFGGKKP-VSTSVNNSLVELSNYNQKREEFDPEYDN
Poptr_ADA2_1       (256)  GPNVVKVEDPQVDRNAKGKKPNSSGSEGPSLMELSGYNPKRQEFDPEYDN
Poptr_ADA2_3       (256)  GP-GVKVEDPQVDRNFKGKKPSSSGSEGPSLMELSGYNPKRQEFDPEYDN
Lyces_ADA2_2       (241)  QNEPVKFEDNSG-RNFGGKKPKSLKDDGSSLMKLSGYIPKRQEFDPEYDN
Orysa_ADA2_1       (242)  GANVAKVEDGHVDRSIGVKKPRYSADEGPSLTELSGYNSKRHEFDPEYDN
Zeama_ADA2_1       (245)  GSNVSKVEDGHVDRSVGVKKPRYSADEGPSLTELSGYNAKRHEFDPEYDN
Zeama_ADA2_2       (245)  GATVSKVEDVHVDRSVGVKKPRYSADEGPSLTELSGYNAKRHEFDPEYDN
Lyces_ADA2_1       (240)  NHDSIKVEGCPADRSVGEKKPRSSVDEGPSMTELSGYNSKREEFEIEYDN
Poptr_ADA2_2       (226)  ---KIKVEEPLSDRSIREKKPRICGEEGPSMTELSGYNFKRQEFEIEYDN
Vitvi_ADA2_1       (251)  GRDNIKVEETQTDRSVGEKKPRTSGDEGPSVTELSGYNFKRQEFDVEYDN
    Consensus      (601)       IKVED   DRSVG KKPR SGDEGPSLTELSGYN KR EFDPEYDN 651                                                700
Arath_ADA2_1       (289)  DAEQLLADMEFKDSDTDAEREQKLQVLRIYSKRLDERKRRKEFVLERNLL
Dicdi_ADA2_1       (601)  EAELVVKDLTFEPDDSQADRDIKLNVLESYDQRLDERIRRRNFIVEKGLL
Ostlu_ADA2_1       (217)  DAELPLAEMEFRENDTEEDVQMKLRMIEIYNSRLQERARRKQFILERNLL
Arath_ADA2_2       (247)  DAEQLLAEMEFKENDTPEEHELKLRVLRIYSKRLDERKRRKEFIIERNLL
Poptr_ADA2_1       (306)  DAEQLLAEMEFKDTDTEEERELKLRVLHIYSKRLDERKRRKDFILERNLL
Poptr_ADA2_3       (305)  DAEQLLAEMEFKDNDTEEERELKLRVLRIYSRRLDERKRRKDFILERNLL
Lyces_ADA2_2       (290)  DAEQLLADMEFKETETEEERELKLRVLRIYSKRLDERKRRKVFILERNLL
Orysa_ADA2_1       (292)  DAEQALAEMEFKETDSETDRELKLRVLRIYLSRLDERKRRKEFILERNLL
Zeama_ADA2_1       (295)  DAEQALAEMEFKETDSETDRELKLRVLRIYLSRLDERKRRKEFILERNLL
Zeama_ADA2_2       (295)  DAEQALAEMEFKETDSETDRELKLRVLRIYLSRLDERKRRKEFILERNLL
Lyces_ADA2_1       (290)  DAEQMVADMEFKETDTNAERELKLRVLRIYNKRLDERKRRKDFILERKLL
Poptr_ADA2_2       (273)  DAEQLLADMEFKDTDTDAELDMKLQVLRIYSKRLDERKRRKDFILERNLF
Vitvi_ADA2_1       (301)  DAEQLLADMEFKDADTDAEHELKLQVLHIYSKRLDERKRRKDFILERNLL
    Consensus      (651)  DAEQLLAEMEFKETDTE  ERELKLRVLRIYSKRLDERKRRKDFILERNLL 701                                                750
Arath_ADA2_1       (339)  YPDQ---YEMSLSAEERKIYKSCKVFARFQSKEEHKELIKKVIEEHQILR
Dicdi_ADA2_1       (651)  DYRK---VERKRYKDDKEILNSLKCFLQTVTKEEHESMINGLINEKNIKN
Ostlu_ADA2_1       (267)  NVKKQQNVEKKRSQYERDLHGTMRIFARFLTSTEYDVLLEGLAAEHRIRT
Arath_ADA2_2       (297)  YPNP---FEKDLSQEEKVQCRRLDVFMRFHSKEEHDELLRNVVSEYRMVK
Poptr_ADA2_1       (356)  QPSP---FEKDLTPEERALCRRYDPFMRFHSKEEHEELLQVVIEEHRMLK
Poptr_ADA2_3       (355)  HPSP---FEKDLTPEERALCRRFDPFMRFHSKEEHEELLRAVVKEHWMLK
Lyces_ADA2_2       (340)  QPSE---FEKNLSPEEKGICRCYDAIMRFLSKEEHEELLKAVVSEHRYLK
Orysa_ADA2_1       (342)  FPNP---LEKDLTNEDKEVYHRYKVFMRFLSKEEHEALVRSVLEERKIRR
Zeama_ADA2_1       (345)  FPNP---LEKDLTNEDREVYHRYKVFMRFLSKEEHEALVRSVIEERKIRR
Zeama_ADA2_2       (345)  FPNP---LEKDLTSEDRELYHRYKVFMRFLSKEEHEALVRSVIEERKIRR
Lyces_ADA2_1       (340)  HPDP---FEKDLTPEEKDICRRYRVFMRFSSKEEHEDFLRSIIEEHRIVK
Poptr_ADA2_2       (323)  YPDA---FEKNISPEEKEIYQRYKVFMRFHTKEEHEELMKTVIEDHQIMK
Vitvi_ADA2_1       (351)  YPDP---FEKNLSPEERDVNQRFKVFMRFHSKEEHEELLRVVLEEHWIQK
    Consensus      (701)  YP P   FEKDLS EEREI RYKVFMRF SKEEHEELLR VIEEHRILK
```

FIGURE 16 (continued)

```
              751                                                800
Arath_ADA2_1  (386) RIEDLQEARTAGCRTTSDANRFIEEKRKKEAEESMLLRLNHGAPGSIAGK
Dicdi_ADA2_1  (698) RILQLQEYRENGIKTLADGQNFDEDKRKREVDKSMKRSKSELASYSLNSG
Ostlu_ADA2_1  (317) RITELKEYRRNGIHTIAEGEDYDLEKRRRETEFARLHAIEHPTSKN----
Arath_ADA2_2  (344) RLKDLKEAQVAGCRSTAEAERYLGRKRKRENEEGMNRGKESGQFG-----
Poptr_ADA2_1  (403) RIEELKEAQAAGCRTAAEADRYLEQKRKKEAEENSSRLKDNALVGPSN--
Poptr_ADA2_3  (402) RVEELKDAQVAGCRTAVEADRYLEHKRKIEAEETSRRLKDNAQIGPSS--
Lyces_ADA2_2  (387) RIQELKEAKAAGCRSSAEVDRYLERKRKKEVEEGVP-RKGSSQIGPMS--
Orysa_ADA2_1  (389) RIQELQECRSAGCRTLAEAKIHIEQKRKKEHEVNAQKAKESGQLLSNT--
Zeama_ADA2_1  (392) RIQELQECRSAGCRTLAEAKIHIEQKRKKEYELNAQKAKESNHLIANT--
Zeama_ADA2_2  (392) RIQELQECRSAGCRTLAEAKIHIEQKRKKEYELNAQKAKDSSQLNANN--
Lyces_ADA2_1  (387) RIRDLQDARIAGCRTLAEAERYVEQKRARESEENIRRLKENTQSGPSG-K
Poptr_ADA2_2  (370) RIQDLQEARAAGCQTAGEAQGFIEQKRKKEAEESAQRAKESMQAGPAG-K
Vitvi_ADA2_1  (398) RIQDLQDARAAGCRTSAEAERYLEEKGKKEAEESAQQAKESAEAGPSGGK
   Consensus  (751) RI ELQEARAAGCRT AEAERYIE KRKKE EE A RAKES Q G 801                                                850
Arath_ADA2_1  (436) TLK-----------SPRGLPRNLHPFG-------SDSLPKVTPPRI----
Dicdi_ADA2_1  (748) LSSYNPNHNPFGHHYLGGSSSGLSGGSGGGGGGGDPSFKTQKQLTKEKE
Ostlu_ADA2_1  (363) ----------------------IARAN-------------NLGPR-----
Arath_ADA2_2  (389) ----------------------QIAG---------EMGSRPPVQAS----
Poptr_ADA2_1  (451) ----------------HGAPNAFIPSE----SVRKDSSTRPVGQGS----
Poptr_ADA2_3  (450) ----------------QGAPNAFMSPD----SVGKDSSTRPAGQGS----
Lyces_ADA2_2  (434) ----------------QESLNIPASSE----SLGIHSNRKPCSQAI----
Orysa_ADA2_1  (437) ----KVVHKTNRPMKIESDGNLDQKKGGASLDSTGRDSPKTTGHAG----
Zeama_ADA2_1  (440) ----KLVQKMNRPMKIESDGNLDPKKG-----GVALDSPKTTGLTS----
Zeama_ADA2_2  (440) ----KSVQKMNRPMKIESDGNLDPKKG-----GAGLDSPKTTGPTS----
Lyces_ADA2_1  (436) YLQRAGHFKVEHDSSPRGVGRG-PEMM----DCCNDLSSTTAPHGV----
Poptr_ADA2_2  (419) LLPKPN----HLDSSPRGAVKCSTVFH----PGGNDSSSMIAKQAI----
Vitvi_ADA2_1  (448) VLQRVNTAKGESDGSPRGGGRGSAGLE----PGIKDTSSTTAGHAI----
   Consensus  (801)                       G            DSK  GA 851                                                900
Arath_ADA2_1  (464) ----------------YSGLDTWDVDGLLGADLLSETEKKMCNETRILPV
Dicdi_ADA2_1  (798) DIYLGIGENRKHHSSKLKKNAKMELEGLPNADALSLKEKQICTTHKLLPQ
Ostlu_ADA2_1  (373) ----------------RRMYLSLDLADLPGVDLLNDDEKELCRSCRLLPV
Arath_ADA2_2  (404) ----------------SSYVNDLDLIGFTESQLLSESEKRLCSEVKLVPP
Poptr_ADA2_1  (477) ----------------ASYANGLDTTGFYETQLLSETEKRLCREIHLPPP
Poptr_ADA2_3  (476) ----------------SSYANDLDIMGFYETQLLSETEKRLCCEIHLPPP
Lyces_ADA2_2  (460) ----------------LSSDTNAGVPAFSAGELLSEPEKQLCQEIRLSPH
Orysa_ADA2_1  (479) ----------------TKHWDDWDIVGFPGAELLSTSEKNLCCQNRLLPN
Zeama_ADA2_1  (477) ----------------VKQWDDWDIVGLPGAKLLSASEKLLCCQNRLLPS
Zeama_ADA2_2  (477) ----------------VKQWDDWDIVGLPGAELLSASEKLLCCQNRLLPS
Lyces_ADA2_1  (477) ----------------GSAVDIWDVSGFSGAELLSEAEKKLCDEMRILPA
Poptr_ADA2_2  (457) ----------------SSTLDEWDIAGFLGADLLSESDKRLCCELRILPA
Vitvi_ADA2_1  (490) ----------------LRSLDVWDITGFPGEDLLSETEKQLCSEIRILPS
   Consensus  (851)                 S  D WDI GF GADLLSESEK LC EIRLLP
```

FIGURE 16 (continued)

```
                    901                                              950
Arath_ADA2_1  (498) HYLKMLDILTREIKKGQ-IKKKSDAYSFFKVEPSKVDRVYDMLVHKGIGD
Dicdi_ADA2_1  (848) QYLIVKQALISESLKTQGVIKLSTAFKLIKLNQVKIHRLLEFFERNHWLK
Ostlu_ADA2_1  (407) QYLSMKVELMREGLKSEKPLNRNHVRNMFKVDPLKAIRVYELLLQHGWVL
Arath_ADA2_2  (438) VYLQMQQVMSHEIFKGN-VTKKSDAYSLFKIDPTKVDRVYDMLVKKGIAQ
Poptr_ADA2_1  (511) VYLKMQEVMTKEIFSGN-ITKKLDAHPLFKIEASKVDRVYDILVKKGIAQ
Poptr_ADA2_3  (510) VYLKMQEVMTKEIFSGN-ITKKSDAHPLFKIEASKVDGVYDMLVKKGIAQ
Lyces_ADA2_2  (494) HYLRMQEVLTIQIYSGN-ITRKSDAYPLFQIEATKVDRVYDMLLKKGVAP
Orysa_ADA2_1  (513) HYLKMQEVLMQEIFKGS-VAKKEDAHVLFKVDPAKVDNVYDMVTKKLGTN
Zeama_ADA2_1  (511) HYLRMQEVLMQEIFKGS-VLKKEDAHVLFKVDPTKVDSVYDMVTKKLGNH
Zeama_ADA2_2  (511) HYLRMQEVLMQEIFKGS-VLKKEDAHVLFKVDPTKVDSVYDMVSKKLGNH
Lyces_ADA2_1  (511) HYLNMSQTMSMGIFNGN-ITKKSDAHGLFNVDPNKIDKVYEMLVKKGLAQ
Poptr_ADA2_2  (491) HYLNMLHIMSIEITKGT-VTNKTDAHSLFKVESSKVDRVYDMLVKKGIAL
Vitvi_ADA2_1  (524) HYLNMLHTMLTETLNGN-ITRKSDAHGLFKVEPSKVDKVYDMFVKKGIVK
   Consensus  (901) HYLKMQEVLT EIFKGN ITKKSDAH LFKVDPSKVDRVYDMLVKKGIA 951                                             1000
Arath_ADA2_1  (547) ST------------------------------------------------
Dicdi_ADA2_1  (898) FNIDCETNTSNTTSNYK---------------------------------
Ostlu_ADA2_1  (457) EDGFVNPGEDEDSEPAPKKSASADEEEDEEDDEVDYETDDNDEDEDEEDD
Arath_ADA2_2  (487) L-------------------------------------------------
Poptr_ADA2_1  (560) P-------------------------------------------------
Poptr_ADA2_3  (559) P-------------------------------------------------
Lyces_ADA2_2  (543) L-------------------------------------------------
Orysa_ADA2_1  (562) EEAPTV--------------------------------------------
Zeama_ADA2_1  (560) VELPTV--------------------------------------------
Zeama_ADA2_2  (560) EEAPTV--------------------------------------------
Lyces_ADA2_1  (560) A-------------------------------------------------
Poptr_ADA2_2  (540) A-------------------------------------------------
Vitvi_ADA2_1  (573) S-------------------------------------------------
   Consensus  (951)

1001
Arath_ADA2_1  (549) ---------
Dicdi_ADA2_1  (915) ---------
Ostlu_ADA2_1  (507) EEEDSEEDD
Arath_ADA2_2  (488) ---------
Poptr_ADA2_1  (561) ---------
Poptr_ADA2_3  (560) ---------
Lyces_ADA2_2  (544) ---------
Orysa_ADA2_1  (568) ---------
Zeama_ADA2_1  (566) ---------
Zeama_ADA2_2  (566) ---------
Lyces_ADA2_1  (561) ---------
Poptr_ADA2_2  (541) ---------
Vitvi_ADA2_1  (574) ---------
   Consensus (1001)
```

FIGURE 16 (continued)

**SEQ ID NO: 181, DNA - *Arabidopsis thaliana***
ATGGGTCGTTCGAAACTAGCTTCTCGTCCTGCTGAGGAAGACCTGAATCCAGGAAAATCAAAAAGG
AAAAAGATATCATTGGGTCCTGAGAATGCTGCGGCATCAATTTCCACCGGAATTGAAGCTGGGAAT
GAGAGGAAACCTGGCCTTTACTGTTGTAACTATTGCGATAAAGATCTGTCTGGTTTGGTTCGTTTC
AAATGTGCTGTTTGTATGGACTTTGATCTTTGTGTGGAATGCTTTTCTGTCGGCGTTGAACTTAAT
CGTCACAAGAACAGTCACCCATATCGTGTTATGGACAATTTGTCTTTTTCGCTTGTTACTTCTGAT
TGGAATGCCGATGAAGAGATACTCCTTCTTGAGGCCATTGCGACATACGGGTTGGCAATTGGAAA
GAAGTTGCAGACCATGTTGGTAGTAAGACAACGACAGAATGTATTAAACACTTCAATTCTGCTTAC
ATGCAGTCACCATGCTTTCCACTTCCGGACTTGTCCCATACTATTGGAAAGAGCAAAGATGAGCTG
CTTGCTATGAGTAAAGATAGTGCAGTCAAAACAGAAATACCTGCATTTGTGAGGCTATCTCCAAAA
GAAGAGTTACCTGTGTCAGCTGAAATCAAACACGAAGCTTCAGGGAAGGTCAATGAAATAGATCCA
CCTTTGTCTGCCTTAGCTGGAGTCAAGAAGAAAGGCAATGTACCGCAGGCTAAGGACATCATCAAG
TTGGAAGCTGCAAAACAACAATCTGACAGGAGTGTCGGGGAGAAGAAACTCAGACTTCCTGGAGAG
AAAGTTCCATTAGTAACAGAGTTATATGGTTACAATCTAAAGAGGGAAGAATTTGAGATCGAACAT
GACAACGATGCTGAGCAACTGCTTGCTGACATGGAATTTAAGGATTCTGACACAGATGCTGAGCGT
GAGCAGAAACTGCAGGTTCTTCGTATTTACTCGAAAAGGCTTGATGAGAGGAAGCGGAGGAAGGAA
TTTGTTCTGGAAAGAAACTTGTTGTACCCTGATCAATATGAGATGAGCCTTTCAGCAGAGGAGAGA
AAAATATATAAAGCTGTAAAGTGTTTGCGCGGTTCCAATCCAAAGAAGAGCACAAGGAACTGATT
AAGAAAGTCATTGAAGAGCACCAAATTCTCAGAAGAATCGAGGATCTTCAGGAAGCTAGAACTGCT
GGTTGCAGGACAACTTCAGACGCAAATAGATTTATAGAAGAGAAGAGAAAGAAGGAAGCTGAAGAA
AGTATGCTGCTGCGGCTTAACCACGGTGCACCAGGCAGTATAGCCGGTAAAACACTAAAAAGTCCA
AGAGGGTTACCCAGAAATTTGCATCCCTTTGGTTCTGACTCACTGCCAAAGGTCACACCTCCAAGA
ATATACAGCGGTTTGGACACTTGGGATGTTGATGGTCTCCTTGGAGCTGACTTACTCTCAGAGACC
GAAAAGAAGATGTGCAATGAGACCAGAATACTGCCTGTACACTATTTGAAGATGTTGGATATCTTA
ACAAGAGAAATAAAGAAGGGGCAGATAAAGAAAAAGTCTGATGCTTATAGCTTCTTCAAAGTAGAG
CCGAGTAAAGTAGACAGAGTATATGATATGCTGGTTCATAAGGGAATAGGTGACTCAACATGA

**SEQ ID NO: 182, protein - *Arabidopsis thaliana***
MGRSKLASRPAEEDLNPGKSKRKKISLGPENAAASISTGIEAGNERKPGLYCCNYCDKDLSGLVRF
KCAVCMDFDLCVECFSVGVELNRHKNSHPYRVMDNLSFSLVTSDWNADEEILLLEAIATYGFGNWK
EVADHVGSKTTTECIKHFNSAYMQSPCFPLPDLSHTIGKSKDELLAMSKDSAVKTEIPAFVRLSPK
EELPVSAEIKHEASGKVNEIDPPLSALAGVKKKGNVPQAKDIIKLEAAKQQSDRSVGEKKLRLPGE
KVPLVTELYGYNLKREEFEIEHDNDAEQLLADMEFKDSDTDAEREQKLQVLRIYSKRLDERKRRKE
FVLERNLLYPDQYEMSLSAEERKIYKSCKVFARFQSKEEHKELIKKVIEEHQILRRIEDLQEARTA
GCRTTSDANRFIEEKRKKEAEESMLLRLNHGAPGSIAGKTLKSPRGLPRNLHPFGSDSLPKVTPPR
IYSGLDTWDVDGLLGADLLSETEKKMCNETRILPVHYLKMLDILTREIKKGQIKKKSDAYSFFKVE
PSKVDRVYDMLVHKGIGDST

**SEQ ID NO: 183, DNA - *Arabidopsis thaliana***
ATGGGTCGCTCTCGAGGGAACTTCCAAAATTTCGAAGACCCTACTCAGAGAACGAGGAAAAAGAAA
AATGCGGCTAATGTGGAGAACTTTGAGTCTACTTCTTTGGTACCAGGTGCTGAGGGAGGAGGGAAG
TATAACTGCGATTATTGCCAGAAAGACATTACTGGAAAAATTAGGATAAAGTGTGCTGTCTGTCCA
GATTTTGATCTCTGTATAGAATGTATGTCTGTTGGAGCAGAGATCACTCCTCACAAATGTGATCAC
CCATACCGAGTTATGGGAAATCTAACTTTCCCGCTTATTTGTCCTGACTGGAGTGCGGATGATGAA
ATGCTTCTCCTGGAGGGACTTGAAATTTATGGCTTGGGAAACTGGGCAGAGGTTGCGGAGCACGTG
GGAACGAAGAGTAAAGAACAGTGTCTTGAGCACTACAGAAACATCTATTTGAACTCACCATTTTTC
CCACTTCCGGATATGTCACATGTAGCAGGGAAGAACAGAAAAGAACTTCAAGCCATGGCTAAAGGA
CGCATTGATGACAAGAAAGCAGAGCAGAACATGAAGAAGAGTACCCGTTCTCTCCTCCTAAAGTC

FIGURE 20

```
AAAGTTGAAGACACACAAAAAGAGTCTTTTGTAGACAGAAGTTTTGGAGGGAAGAAACCTGTTTCC
ACCTCGGTAAACAACTCTTTGGTTGAGCTGAGTAATTACAACCAGAAAAGAGAAGAGTTTGACCCT
GAATATGACAATGATGCTGAGCAACTCTTGGCGGAGATGGAGTTCAAAGAGAACGATACTCCTGAA
GAACATGAACTGAAGCTGCGTGTGTTGCGTATCTATTCAAAAAGGCTTGATGAGAGGAAACGTAGA
AAAGAATTCATAATAGAAAGAAACCTGTTGTACCCAAATCCCTTTGAGAAGGACCTGTCTCAGGAG
GAGAAAGTACAATGCCGACGTTTGGACGTTTTTATGCGTTTTCATTCAAAAGAGGAGCACGACGAG
CTACTCCGTAATGTTGTAAGCGAGTACCGCATGGTGAAACGGCTCAAAGATCTCAAGGAAGCTCAA
GTGGCAGGGTGTCGTTCAACGGCTGAAGCAGAGAGGTATCTGGGAAGGAAGAGGAAGAGAGAAAAC
GAAGAAGGGATGAACAGAGGGAAAGAGAGCGGTCAATTTGGTCAAATTGCAGGGGAGATGGGCTCT
AGACCACCTGTGCAAGCTTCTTCAAGCTATGTGAATGATTTGGACTTGATTGGGTTCACGGAGTCG
CAACTGCTGTCTGAATCCGAGAAGCGTCTCTGCAGCGAGGTCAAGTTGGTTCCACCGGTTTATCTA
CAGATGCAACAAGTGATGTCACATGAGATATTCAAGGGAATGTAACGAAGAAGTCGGATGCATAT
AGCCTTTTCAAGATTGATCCAACCAAAGTGGATCGAGTTTATGATATGCTTGTGAAGAAGGGTATT
GCTCAACTTTAA
```

**SEQ ID NO: 184, protein - *Arabidopsis thaliana***
```
MGRSRGNFQNFEDPTQRTRKKKNAANVENFESTSLVPGAEGGGKYNCDYCQKDITGKIRIKCAVCP
DFDLCIECMSVGAEITPHKCDHPYRVMGNLTFPLICPDWSADDEMLLLEGLEIYGLGNWAEVAEHV
GTKSKEQCLEHYRNIYLNSPFFPLPDMSHVAGKNRKELQAMAKGRIDDKKAEQNMKEEYPFSPPKV
KVEDTQKESFVDRSFGGKKPVSTSVNNSLVELSNYNQKREEFDPEYDNDAEQLLAEMEFKENDTPE
EHELKLRVLRIYSKRLDERKRRKEFIIERNLLYPNPFEKDLSQEEKVQCRRLDVFMRFHSKEEHDE
LLRNVVSEYRMVKRLKDLKEAQVAGCRSTAEAERYLGRKRKRENEEGMNRGKESGQFGQIAGEMGS
RPPVQASSSYVNDLDLIGFTESQLLSESEKRLCSEVKLVPPVYLQMQQVMSHEIFKGNVTKKSDAY
SLFKIDPTKVDRVYDMLVKKGIAQL
```

**SEQ ID NO: 185, DNA - *Dictyostelium discoideum***
```
ATGACTTCAACAATAAATAAAGAAGAACCTACAACACTTGTAAATAAAAAAAGGAGAAAAGAACAT
GTTGATGATGACGATGATAATGATGATGACATTGAAATGCAAATGTATCAAATGATAATATTAAT
AATACAGATGATGAAAATAATAATGTAAATACAAATGGAAATAATACAAACAAAACCAACAACAAC
AACAACAACAACAACAACAACAACAATAATAATGAAGAAGATGACGATGAAGAAGACTTATTA
ATTACCAAAAGAAGGAATAGTAGATCAACAACAATGAGTAATAATAGTAGTAATAAATCAACACCA
TCTAAAAAGAAAGAATTAAGAAATCATATGATAATGATAAAGATTTTGTAGGAGATGATGAAGAG
GAAGATGATAATGATGATGAAGATGATGATGGTGATGTTGTAATCTCAAATAATAATAATAATAAT
AATAATAATAATACTAATAATAATAATAATAATAATAATGGTAATGGTAATGGTAATAACAATACA
AACAATTCATTCGAAGAAGATGATGATGAAGAGGATGATGATGAAGAAGATGAAGAAGAAGAAGAA
GAAGGTATGAAAATATCAAAAAGTAAAAGACAAACACAAATAATACCACCAACACAAAGTGAAGTT
GATGATCTTGTAAATAAAAGTTTTAATAGTGTAGATGATGATGAAGAAGATAATGAAGAGGATGAT
AAAACAAAAAATACTACTACTACTACTGCTACAAATACTACTAATGTACCAACAACAACAACAACA
ACTACAACAACATCGAACAATACTACATTACCAACTACTACCACTACTACCACCACTAATAATACA
ACAAAACCAAATGTTAAAATAGAACAACCAAAAACACAACAACCACCACAACCACAACCAATAAAT
AAACCAACTCAATCAAATACTATCACAACAAATACAAATACAAGTACAAATACAAACACAGCTACA
AATACAAATTCAAATACAGCTACAGCCACAACAACATCACCTACCTCAATGACAAAACAAACAAGG
AAGTCAACCAATTCACCAACTAACAGTAATGGTAATAATAATAATAATAATAATAATAATAATTTT
ATAGAGGAACAAGTGAATGAAGGATTATATCATTGTGATTATTGTCAAAAGGATATTAGTGGTGTT
GTACGTATAAGATGTTCAGTATGTACTGATTTCGATTTATGTTTAGAATGTTTTAGTGTTGGTGTA
GAGATTACACCACATCGTAATTTTCATGATTATCATGTAGTTGATAATATGCATTTCCCAATGTTT
ACTGATGATTGGGGTGCTGATGAAGAATTATTACTTTTAGAAGCAATTGAATTATATGGTTTAGGT
AATTGGAATGAAGTTTCAGAGAATGTAGGCGCACATTCAAAATCACCTTTAGAATGTAAAGCACAT
```

TATTTCGCTCATTATTTAAATAGTTCAACTTCACCTTTACCAGATACATCAAAGGTTTTAACTACA
AATGAAAATGTTCACTTTAAAAGAGCAAAAACAACTGTAAATGGTAATTATTATAATGATTATATT
ATTGATAATAGTGACGATGATGATAATAATAATAATAATAATAATTATAACGATAATAGTAATAAT
ACAACACCAACAAAGTCATTCAATAGTGTTAATAAAAGTAAAAAATTAAATCATAGAAATAGTCAT
GGTGAAGAAGGACCAAGTGGACCAGTAACAGATTCAGTTGGATATATGAAGAATAGAGGACATTTT
GAAGTAGAATATGATAATGAAGCAGAGTTGGTTGTAAAGGATTTAACATTTGAACCTGACGATAGT
CAAGCAGATAGAGATATTAAATTGAATGTATTAGAATCCTATGATCAAAGATTGGATGAACGTATT
AGAAGAAGGAATTTCATTGTTGAGAAAGGTTTATTAGATTATAGAAAAGTAGAGAGAAAACGATAC
AAAGATGATAAAGAGATATTAAATTCATTGAAATGTTTCCTTCAAACAGTTACCAAAGAAGAGCAT
GAATCAATGATAAATGGATTAATAAATGAAAAGAATATAAAGAATAGAATTCTACAATTACAAGAG
TATCGTGAAAATGGTATTAAAACATTGGCAGATGGTCAAAATTTTGATGAAGATAAAAGAAAACGT
GAAGTTGATAAATCTATGAAACGTTCCAAATCTGAATTGGCATCATATAGTTTAAATAGTGGATTA
AGTTCATACAATCCAAATCATAATCCATTTGGTCATCATTATTTAGGTGGTAGTAGTAGTGGATTA
AGTGGTGGTAGTGGTGGAGGTGGTGGTGGTGGTGGTGATCCATCATTTAAAACTCAAAAACAATTA
ACTAAAGAAAAAGAAGATATTTATTTAGGTATTGGTGAGAATAGGAAACATCATTCAAGTAAATTG
AAAAAGAATGCTAAAATGGAATTGGAAGGTTTACCAAATGCTGATGCACTCTCATTAAAAGAGAAA
CAAATTTGTACAACTCATAAACTTTTACCACAACAATACCTAATTGTCAAACAAGCATTAATCTCT
GAATCTTTAAAAACTCAAGGTGTAATTAAATTATCAACCGCTTTTAAACTAATTAAATTAAATCAA
GTTAAAATTCATAGACTTTTAGAATTCTTTGAAAGAAATCATTGGTTAAAATTTAATATTGATTGT
GAAACTAACACTTCTAATACTACTTCAAATTATAAATAA

SEQ ID NO: 186, protein - Dictyostelium discoideum
MTSTINKEEPTTLVNKKRRKEHVDDDDDNDDDIEMQNVSNDNINNTDDENNNVNTNGNNTNKTNNN
NNNNNNNNNNNNEEDDDEEDLLITKRRNSRSTTMSNNSSNKSTPSKKKRIKKSYDNDKDFVGDDEE
EDDNDDEDDDGDVVISNNNNNNNNNNTNNNNNNNGNGNGNNNTNNSFEEDDDEEDDDEEDEEEEE
EGMKISKSKRQTQIIPPTQSEVDDLVNKSFNSVDDDEEDNEEDDKTKNTTTTTATNTTNVPTTTTT
TTTTSNNTTLPTTTTTTTTNNTTKPNVKIEQPKTQQPPQPQPINKPTQSNTITTNTNTSTNTNTAT
NTNSNTATATTTSPTSMTKQTRKSTNSPTNSNGNNNNNNNNNNNFIEEQVNEGLYHCDYCQKDISGV
VRIRCSVCTDFDLCLECFSVGVEITPHRNFHDYHVVDNMHFPMFTDDWGADEELLLLEAIELYGLG
NWNEVSENVGAHSKSPLECKAHYFAHYLNSSTSPLPDTSKVLTTNENVHFKRAKTTVNGNYYNDYI
IDNSDDDDNNNNNNNYNDNSNNTTPTKSFNSVNKSKKLNHRNSHGEEGPSGPVTDSVGYMKNRGHF
EVEYDNEAELVVKDLTFEPDDSQADRDIKLNVLESYDQRLDERIRRRNFIVEKGLLDYRKVERKRY
KDDKEILNSLKCFLQTVTKEEHESMINGLINEKNIKNRILQLQEYRENGIKTLADGQNFDEDKRKR
EVDKSMKRSKSELASYSLNSGLSSYNPNHNPFGHHYLGGSSSGLSGGSGGGGGGGDPSFKTQKQL
TKEKEDIYLGIGENRKHHSSKLKKNAKMELEGLPNADALSLKEKQICTTHKLLPQQYLIVKQALIS
ESLKTQGVIKLSTAFKLIKLNQVKIHRLLEFFERNHWLKFNIDCETNTSNTTSNYK

SEQ ID NO: 187, DNA - Lycopersicum esculentum
ATGGGTCGTTCTCGGGCTGTTCATCAATCCACTGATGATGATCCAAGCCAGAGGTCTAAGAGAAAA
AGGGCAGTGCCAAATGTGGAGAGTTTTGATACTGCAGCTACTGGCCAAATATTGACTGAAGGGAAA
AAGGCTTTGTACCATTGCAATTATTGCAATAAAGACATATCTGGAAGGATTCGGATTAAATGTGTT
GTGTGTTCTGACTTTGATCTTTGTGTGGAATGCTTTTCTGTTGGAGCAGAAGTGCAGCCTCACAAA
AGCAATCATCTGTATAGGGTTATGGATAACCTGTCATTTCCTCTCATATGTCTGACTGGAATGCT
GATGAGGAAATGTTACTTCTAGAGGGTTTGGAAATGTACGGATTGGCAAACTGGGCTGAAGTTGCC
GAACATGTTGGAACGAAGAGTAAACAGCAGTGTATTGACCACTATAAGTCCACCTATATTAGTTCT
CCTTGTTTTCCGCTTCCGGACATGTCCCATGTTATGGGAAAGAACAGAGAGGAACTTCTTGCCATG
GCCAAGGATCAAGGATATGCAGCTCCCGGGGGAGTTAATGTTAAAGAAGAGTCTCCATTCTCTGCA
GGAATCAAGATGGAAGATCAAAGGGAAGAAAATTCAACTGGACTTGCCTCAGTTGGAGGTTCTGCT

```
TCTGGTACATTAGCAGGAGCTGGAAAGAGGACATCTAGCTTACTTCATAGTAAGGAGAATCATGAT
AGCATCAAAGTGGAAGGTTGTCCTGCAGACAGGAGTGTCGGAGAGAAAAAGCCTAGGTCATCAGTG
GACGAGGGGCCTTCCATGACAGAATTAAGTGGTTATAATTCCAAGAGAGAGGAGTTTGAAATTGAA
TACGATAATGATGCTGAGCAGATGGTGGCTGATATGGAATTTAAAGAGACAGATACCAATGCTGAG
CGTGAACTGAAACTTCGGGTATTGCGTATATACAATAAAAGGCTTGATGAGAGGAAACGTAGGAAG
GATTTTATTTTGGAAAGGAAACTACTTCATCCTGATCCTTTTGAGAAAGACCTCACCCCGGAGGAG
AAGGACATATGCCGTCGTTACAGGGTGTTCATGCGTTTTAGTTCTAAAGAGGAGCATGAGGATTTC
CTTAGGAGCATAATCGAGGAGCACCGAATAGTTAAACGAATACGAGATCTTCAGGATGCCCGAATT
GCTGGTTGCCGAACTTTAGCTGAGGCAGAAAGATATGTTGAACAAAAGAGAGCGCGGGAATCTGAA
GAAAATATACGTAGACTGAAGGAGAACACCCAGAGTGGCCCAAGTGGAAAATATTTGCAAAGAGCA
GGTCACTTTAAAGTGGAGCATGACAGCAGCCCCAGAGGAGTTGGTAGGGGCCCTGAAATGATGGAT
TGTTGCAATGACTTATCATCAACCACCGCACCACATGGTGTTGGAAGTGCTGTAGACATTTGGGAT
GTCAGTGGGTTTTCAGGAGCTGAGTTGCTCTCAGAAGCTGAAAAAAGCTTTGTGATGAGATGAGA
ATCCTGCCGGCTCATTATCTAAACATGTCGCAAACCATGTCCATGGGGATCTTTAATGGCAACATC
ACCAAGAAATCTGATGCGCATGGTCTATTCAATGTTGATCCGAATAAGATTGACAAAGTGTATGAG
ATGCTTGTCAAAAAGGGCCTGGCTCAAGCATAA
```

**SEQ ID NO: 188, protein - *Lycopersicum esculentum***
```
MGRSRAVHQSTDDDPSQRSKRKRAVPNVESFDTAATGQILTEGKKALYHCNYCNKDISGRIRIKCV
VCSDFDLCVECFSVGAEVQPHKSNHLYRVMDNLSFPLICADWNADEEMLLLEGLEMYGLANWAEVA
EHVGTKSKQQCIDHYKSTYISSPCFPLPDMSHVMGKNREELLAMAKDQGYAAPGGVNVKEESPFSA
GIKMEDQREENSTGLASVGGSASGTLAGAGKRTSSLLHSKENHDSIKVEGCPADRSVGEKKPRSSV
DEGPSMTELSGYNSKREEFEIEYDNDAEQMVADMEFKETDTNAERELKLRVLRIYNKRLDERKRRK
DFILERKLLHPDPFEKDLTPEEKDICRRYRVFMRFSSKEEHEDFLRSIIEEHRIVKRIRDLQDARI
AGCRTLAEAERYVEQKRARESEENIRRLKENTQSGPSGKYLQRAGHFKVEHDSSPRGVGRGPEMMD
CCNDLSSTTAPHGVGSAVDIWDVSGFSGAELLSEAEKKLCDEMRILPAHYLNMSQTMSMGIFNGNI
TKKSDAHGLFNVDPNKIDKVYEMLVKKGLAQA
```

**SEQ ID NO: 189, DNA - *Lycopersicum esculentum***
```
ATGGGTCGCTCTCGTGGGAATTTTCAAGCTGATGAAGATCCCAGCCAAAGATCAAGGAGGAAAAAG
AATGCCTCAAGTGTAGACAATTTAGAATCTGCGACCACTGGTCAAGGGACAGCTGATGGCAAAAGG
GCCTTGTATCACTGCAATTATTGCAACAAAGACATTAGCGGGAGAACTCGTATAAAATGTGCTGTA
TGTTACGATTTTGACCTATGTATAGAGTGCTTCTCTGTTGGTGCTGAGGTGCATCCCCACAAAAGC
CATCACCACTATAGGGTTATGGATATCTTAGCTTTCCCGCTTATTGCCCAGACTGGAATGCTGAT
GAAGAGATGTTGCTCCTTGAGGGAATTGAGATGTATGGCATGGGTAATTGGGCTGAAGTAGGTGAG
CATGTCGGAACAAAGACAAAAGAAGCCTGCATTGACCATTTTAAGGATGCGTACTTAAAGTCACCT
TACTTTCCTCTACCAGATATGACTCACGTCATGGGGAAAAACAGAATGGAACTCCTTGCCATGGCT
AAAGGGAATTTCACTGATAAGAAAGGACTCTCTTCACTTGGTGATGTTGCTCCTAAAGATGAATCG
TTCTCTCCGTCTCGAATCAAAGTTGAAGACACTCATAAAATTGGTCCTTCAGGACGTTTAACTTCT
GTATCCAATGCGGGAATCACAGGCATAAAAAAGCCATCCAGCAAAACGCTAATCAAAGATCAAAAT
GAACCTGTTAAATTTGAAGATAATTCAGGCAGAAATTTTGGAGGCAAGAAACCGAAATCTTTGAAG
GATGATGGATCCTCATTGATGAAATTAAGTGGATATATTCCAAGAGGCAAGAATTTGATCCTGAA
TATGATAATGATGCGGAGCAACTATTGGCTGATATGGAATTCAAGGAAACTGAAACTGAAGAGGA
CGCGAACTTAAGCTGCGTGTTCTGCGTATCTATTCCAAGAGGCTTGATGAAAGAAAACGCCGCAAG
GTTTTTATTCTAGAGAGGAATTTACTCCAGCCAAGTGAATTTGAGAAGAATTTGTCACCAGAAGAG
AAAGGTATATGCCGATGTTATGATGCCATTATGCGCTTTCTCTCGAAGGAGGAGCATGAAGAATTA
CTTAAGGCTGTGGTCTCAGAACATAGATATCTGAAAAGAATACAAGAACTCAAGGAAGCGAAAGCT
GCAGGTTGTCGTTCGTCTGCTGAAGTTGATAGGTACTTAGAAAGGAAAAGGAAGAAGGAAGTTGAA
```

GAAGGTGTTCCGAGAAAGGGAAGCTCTCAGATTGGCCCAATGAGCCAGGAAAGCCTGAACATACCT
GCTTCTTCTGAGTCACTTGGAATACATTCAAATAGAAAACCTTGTAGCCAGGCGATTTTGAGTTCC
GACACCAATGCAGGTGTTCCAGCTTTTTCTGCAGGAGAACTGTTATCTGAACCTGAGAAACAACTA
TGTCAAGAAATCAGGTTATCGCCGCATCATTATCTTAGGATGCAGGAGGTCCTTACAATACAAATT
TATAGTGGTAATATCACTAGAAAATCAGATGCTTATCCTTTGTTTCAAATAGAAGCAACTAAAGTA
GATAGAGTTTATGATATGCTTTTGAAGAAAGGAGTTGCACCCTTGTAA

**SEQ ID NO: 190, protein - *Lycopersicum esculentum***
MGRSRGNFQADEDPSQRSRRKKNASSVDNLESATTGQGTADGKRALYHCNYCNKDISGRTRIKCAV
CYDFDLCIECFSVGAEVHPHKSHHHYRVMDILAFPLICPDWNADEEMLLLEGIEMYGMGNWAEVGE
HVGTKTKEACIDHFKDAYLKSPYFPLPDMTHVMGKNRMELLAMAKGNFTDKKGLSSLGDVAPKDES
FSPSRIKVEDTHKIGPSGRLTSVSNAGITGIKKPSSKTLIKDQNEPVKFEDNSGRNFGGKKPKSLK
DDGSSLMKLSGYIPKRQEFDPEYDNDAEQLLADMEFKETETEEERELKLRVLRIYSKRLDERKRRK
VFILERNLLQPSEFEKNLSPEEKGICRCYDAIMRFLSKEEHEELLKAVVSEHRYLKRIQELKEAKA
AGCRSSAEVDRYLERKRKKEVEEGVPRKGSSQIGPMSQESLNIPASSESLGIHSNRKPCSQAILSS
DTNAGVPAFSAGELLSEPEKQLCQEIRLSPHHYLRMQEVLTIQIYSGNITRKSDAYPLFQIEATKV
DRVYDMLLKKGVAPL

**SEQ ID NO: 191, DNA - *Ostreococcus lucimarinus***
ATGGCGAGCGCGCTCGTGCCGAAACGGCGACGGGTGGCGACGGAAAACGCGATGACGAAGCTGAGT
GGGAACGGGGAGTCGTGCGCACTGTTTAACTGTAACTATTGCCAAAAGGACATCTCGAACGTGGTG
CGCGTACGGTGCGCGGAGTGCGCAAACGTGGATCTGTGCACGGAGTGCTTCGCGGTCGGCGTGGAG
CCGCACCCGCACAAGGCGTATCATCAGTATCACGTCATCGACAACATGTCGTTTCCGCTGTTCACG
CGAGATTGGGGGGCTGACGAAGAGTTGTTATTGCTGGAGGCAGTGGAGATGTTCGGGTTGGGGAAC
TGGACCGAGGTGAGCGAACACGTCGGGACGAAGACGCGCGCAGTGTCACGCGCACTATTTTGAA
GTCTACGTCAAGTCTCCTTGCGCGCCGTTACCGGATATGTCGAAGATTTTAGGAAAAGGCGTCGCG
CGTATGACATCAGACGAGCTCAAAGCGGAGGCGGAGCAAAAGGCGAACGAAAATAAGGATGTGGAG
GAGGAGGAGAAGCTTCTCGAATCGCTTGCTAACCCGAACGCAGTGAAGACGGAGGGCAACGTGCAG
GAACTCACAGGTTACAACATCAAGCGCAATGAGTTCGATCCCGAATACGACATGGATGCCGAACTT
CCCCTGGCGGAGATGGAATTTCGCGAAAACGACACCGAAGAAGACGTCCAGATGAAGCTGCGAATG
ATTGAAATCTACAACAGCCGGCTTCAAGAACGAGCGAGAAGAAAACAATTCATTCTCGAACGCAAT
CTGCTGAACGTGAAAAAGCAACAAAACGTGGAAAAGAAGCGTTCACAATACGAGCGCGACTTACAC
GGCACCATGCGTATATTTGCACGCTTTCTCACGAGTACCGAGTACGACGTCTTGCTCGAGGGTCTC
GCCGCGGAGCACCGAATCCGAACCCGCATCACCGAACTGAAAGAGTACAGACGCAATGGTATTCAT
ACCATCGCAGAGGGCGAGGATTACGATTTGGAGAAGCGTCGTCGTGAGACGGAGTTCGCTCGTCTA
CACGCGATCGAGCATCCAACTAGCAAGAACATAGCCAGAGCGAACAACTTAGGTCCTCGCCGTCGA
ATGTACTTGTCACTTGATCTCGCCGATCTTCCAGGCGTAGACCTTTTGAACGACGACGAAAAGGAG
TTGTGCAGGAGCTGTCGCTTATTGCCTGTGCAGTATCTCTCGATGAAGGTGGAGTTGATGCGAGAG
GGTCTCAAGTCCGAAAAGCCGCTCAACAGAAATCACGTTCGGAATATGTTCAAAGTAGACCCACTC
AAGGCTATTCGTGTGTATGAGTTACTCCTACAGCACGGCTGGGTGTTGGAAGACGGCTTCGTGAAC
CCAGGTGAGGATGAAGACTCCGAACCTGCGCCGAAAAAGTCAGCCAGCGCAGACGAGGAGGAAGAC
GAGGAGGACGATGAAGTAGATTACGAAACCGACGATAACGACGAAGACGAGGACGAGGAAGACGAC
GAGGAAGAGGATAGCGAGGAAGACGATTAG

**SEQ ID NO: 192, protein - *Ostreococcus lucimarinus***
MASALVPKRRRVATENAMTKLSGNGESCALFNCNYCQKDISNVVRVRCAECANVDLCTECFAVGVE
PHPHKAYHQYHVIDNMSFPLFTRDWGADEELLLEAVEMFGLGNWTEVSEHVGTKTRAQCHAHYFE
VYVKSPCAPLPDMSKILGKGVARMTSDELKAEAEQKANENKDVEEEEKLLESLANPNAVKTEGNVQ

FIGURE 20 (continued)

ELTGYNIKRNEFDPEYDMDAELPLAEMEFRENDTEEDVQMKLRMIEIYNSRLQERARRKQFILERN
LLNVKKQQNVEKKRSQYERDLHGTMRIFARFLTSTEYDVLLEGLAAEHRIRTRITELKEYRRNGIH
TIAEGEDYDLEKRRRETEFARLHAIEHPTSKNIARANNLGPRRRMYLSLDLADLPGVDLLNDDEKE
LCRSCRLLPVQYLSMKVELMREGLKSEKPLNRNHVRNMFKVDPLKAIRVYELLLQHGWVLEDGFVN
PGEDEDSEPAPKKSASADEEEDEEDDEVDYETDDNDEDEDEEDDEEEDSEEDD

**SEQ ID NO: 193, DNA - *Oryza sativa***
ATGGGCCGGTCTCGCGGGGTGCCCAATTCCGGCGACGATGAAACGAACCACAGGTCGAAGCGGAGG
AGGGTCGCGTCGAGCGGCGATGCGCCGGACTCGCTCTCGGCGGCCTGCGGGGGAGCCGGAGAGGGT
GGTGGGAAGAAGGCGCTGTACCACTGCAACTACTGCAATAAGGATATTTCCGGGAAGATCCGGATC
AAGTGCTCCAAGTGCCCCGACTTCGACCTCTGCGTCGAGTGCTTCTCGGTCGGCGCCGAGGTCACC
CCGCACCGCAGCAACCATCCTTACAGGGTCATGGACAACCTGTCTTTCCCTCTTATTGTCCAGAT
TGGAATGCAGACGAGGAAATCCTTCTTCTAGAGGGAATTGAAATGTATGGTCTGGGAAATTGGGCT
GAAGTTGCGGAGCATGTTGGCACCAAGACCAAGGCACAATGCATTGATCATTATACAACTGCATAC
ATGAACTCACCTTGTTATCCCCTTCCGGATATGTCTCATGTTAACGGTAAGAACAGGAAGGAATTG
CTTGCTATGGCTAAAGTACAAGGCGAGAGTAAAAAAGTGTTACCAGGGGATTTGACCCCTAAGGAC
GAGTCTCCATTTTCTCCCCAAGGGTCAAGGTGGAAGATGCACTTGGAGAAGGTTTAGCTGGTCGA
TCACCTTCACACATAGCTGGGGGTGCAAATAAGAAAGCATCAAATGTTGGACAATTCAAAGATGGT
GCTAATGTAGCAAAAGTTGAAGATGGTCATGTGGATAGAAGTATAGGTGTGAAAAAACCCCGATAT
TCTGCAGATGAAGGGCCTTCTTTGACTGAACTGAGTGGATACAATTCAAAGAGACATGAATTTGAC
CCAGAGTATGATAACGATGCTGAACAGGCACTCGCTGAGATGGAGTTTAAAGAAACTGATTCGGAA
ACTGATCGTGAACTGAAGCTAAGGGTATTGCGTATTTACTTGTCAAGGCTTGATGAAAGAAAAAGG
AGAAAAGAGTTCATACTGGAAAGAAACTTACTATTTCCTAATCCTTTGGAGAAGGATCTCACAAAT
GAAGACAAGGAAGTTTACCATCGCTATAAGGTGTTCATGCGTTTCCTTTCTAAGGAGGAACATGAA
GCACTTGTTAGGAGTGTTCTTGAGGAACGGAAAATTCGAAGGAGGATTCAAGAGCTTCAGGAATGT
CGTTCTGCTGGATGCCGTACATTGGCTGAAGCAAAGATTCACATAGAGCAAAAGAGGAAAAAGGAA
CATGAGGTGAATGCCCAAAAAGCTAAGGAAAGTGGTCAGCTCTTATCCAACACTAAAGTGGTGCAT
AAGACGAATCGACCTATGAAAATCGAGTCAGATGGTAATTTGGATCAGAAGAAAGGTGGTGCCAGC
TTGGATTCTACTGGCAGGGATTCTCCAAAAACCACAGGGCATGCAGGCACTAAACATTGGGATGAC
TGGGATATTGTTGGTTTTCCTGGGGCAGAGCTATTAAGCACCAGTGAAAAAAATCTATGCTGTCAG
AACAGATTGCTACCCAACCATTACCTGAAAATGCAGGAGGTTTTGATGCAGGAAATATTCAAGGGT
AGTGTCGCCAAGAAGGAAGATGCCCATGTATTATTTAAGGTTGACCCTGCCAAAGTAGATAACGTT
TATGATATGGTGACGAAAAAGTTGGGTACCAATGAGGAGGCCCCGACTGTTTAG

**SEQ ID NO: 194, protein - *Oryza sativa***
MGRSRGVPNSGDDETNHRSKRRRVASSGDAPDSLSAACGGAGEGGGKKALYHCNYCNKDISGKIRI
KCSKCPDFDLCVECFSVGAEVTPHRSNHPYRVMDNLSFPLICPDWNADEEILLLEGIEMYGLGNWA
EVAEHVGTKTKAQCIDHYTTAYMNSPCYPLPDMSHVNGKNRKELLAMAKVQGESKKVLPGDLTPKD
ESPFSPPRVKVEDALGEGLAGRSPSHIAGGANKKASNVGQFKDGANVAKVEDGHVDRSIGVKKPRY
SADEGPSLTELSGYNSKRHEFDPEYDNDAEQALAEMEFKETDSETDRELKLRVLRIYLSRLDERKR
RKEFILERNLLFPNPLEKDLTNEDKEVYHRYKVFMRFLSKEEHEALVRSVLEERKIRRRIQELQEC
RSAGCRTLAEAKIHIEQKRKKEHEVNAQKAKESGQLLSNTKVVHKTNRPMKIESDGNLDQKKGGAS
LDSTGRDSPKTTGHAGTKHWDDWDIVGFPGAELLSTSEKNLCCQNRLLPNHYLKMQEVLMQEIFKG
SVAKKEDAHVLFKVDPAKVDNVYDMVTKKLGTNEEAPTV

**SEQ ID NO: 195, DNA - *Populus trichocarpa***
ATGGGTCGTTCTCGAGGGAATTTTCACTCTAATGATGAAGACCCTACTCAGAGATCAAGAAGGAAG
AAGAATGCGGCAAGTGGAGATAATTCCGAATCTTTATTGGCTGGCCAAGGAAGTGGTGATGGGAAA
AGGGCATTATACCATTGCAATTATTGCAATAAAGATATAACAGGGAAGACCCGTATCAAATGCGCT

FIGURE 20 (continued)

ATGTGCCCTGATTTTGACCTATGCTTAGAGTGCTTCTCTGTAGGAGCTGAGGTTACACCTCATAAA
AGCAATCACCCTTACAGGGTTATGGATAATTTATCTTTCCCGCTTATTTGCCCTGATTGGAATGCA
GATGAAGAAATACTGCTTCTAGAGGGAATTGAAATGTATGGATTGGGGAACTGGGCAGAAATTGCT
GAGCACGTGGGGACAAAGAGTAAAGACACATGTATTGAACACTATAATAGTGTTTACATGCAATCC
CAGTACTTCCCTCTCCCGGACATGTCGCTTGTTGTTGGGAAAAATAGAAAGGAACTTCTTGCTATG
GCCAAGGGATATAGTGAGGACAAAAAAGGTGCTGCTATGCTTGGGGATCTTACTTTGAAGGAAGAA
TCTCCATTTTCTCCTTCAAGAGTGAAAGTCGAAGAAATGCATAAAGGAGGTTCCTCTGGCCGATTA
TCAACATTAAACTCAGAGGTAGAATCTGCTGGCCGTCCTACTACCACAAACTCTGCAGCAACAGCT
GCTAATAAGAAGGCATCTAGCATTGCTCGGGTTAAAGATGGACCTAATGTTGTTAAAGTGGAAGAT
CCTCAGGTGGACCGAAATGCTAAAGGAAGAAACCGAATTCCTCTGGGAGTGAGGGTCCATCTTTA
ATGGAGTTGAGCGGTTATAACCCCAAGAGGCAGGAGTTTGATCCCGAATATGATAATGATGCTGAG
CAGTTGCTAGCTGAGATGGAATTTAAAGATACTGACACTGAGGAAGAGCGGGAGCTGAAATTGCGA
GTGCTGCATATATATTCAAAGCGGCTCGACGAGAGAAAGCGCAGAAAGATTTCATACTAGAAAGA
AATCTGCTGCAACCAAGTCCTTTTGAAAAGGACTTGACTCCAGAAGAGAGGGCATTATGTCGGCGT
TATGACCCTTTCATGCGTTTTCATTCCAAGGAAGAGCATGAGGAATTGCTTCAGGTTGTTATCGAA
GAGCATCGGATGCTGAAAAGGATCGAAGAGCTGAAGGAAGCTCAAGCAGCTGGTTGCCGCACAGCA
GCTGAGGCGGACAGGTACCTTGAGCAGAAGAGGAAAAAAGAAGCCGAGGAAAATTCCAGTAGACTG
AAAGACAATGCTCTGGTTGGTCCTAGCAACCATGGTGCTCCCAATGCATTTATTCCGTCAGAGTCT
GTTAGGAAGGATTCGAGTACTAGACCTGTAGGACAGGGCTCTGCTAGCTATGCCAATGGTTTGGAC
ACAACAGGCTTTTATGAAACGCAGCTACTATCTGAAACTGAAAAACGGCTATGCCGTGAGATTCAC
CTACCTCCTCCTGTCTACCTCAAGATGCAAGAGGTCATGACCAAAGAGATCTTCAGCGGTAACATC
ACTAAGAAATTGGATGCTCACCCCTTGTTCAAGATTGAAGCAAGCAAAGTTGATAGGGTGTATGAT
ATACTTGTGAAGAAGGGGATTGCTCAACCTTGA

**SEQ ID NO: 196, protein - *Populus trichocarpa***
MGRSRGRPPSSGTSTAAAASDDPNNRSSKRKKTTSNVGSIETAFPAVYQEKGQGKLALYHCNYCHK
DISGMVRIKCAVCPDFDLCVECFSVGAEVTPHKSNHPYRVMDNLSFPLFHPDWNTDEEILLLEGIE
MYGFGNWTEVSEHAGTKSKSQCIDHYNAVYMDSPCFPLPDMSHVMGKTREELLAMARGNVEMKKEV
SSHMGSSSGNTFSDAVKKASNEAQIKDKIKVEEPLSDRSIREKKPRICGEEGPSMTELSGYNFKRQ
EFEIEYDNDAEQLLADMEFKDTDTDAELDMKLQVLRIYSKRLDERKRRKDFILERNLFYPDAFEKN
ISPEEKEIYQRYKVFMRFHTKEEHEELMKTVIEDHQIMKRIQDLQEARAAGCQTAGEAQGFIEQKR
KKEAEESAQRAKESMQAGPAGKLLPKPNHLDSSPRGAVKCSTVFHPGGNDSSSMIAKQAISSTLDE
WDIAGFLGADLLSESDKRLCCELRILPAHYLNMLHIMSIEITKGTVTNKTDAHSLFKVESSKVDRV
YDMLVKKGIALA

**SEQ ID NO: 197, DNA - *Populus trichocarpa***
ATGGGTCGTTCGCGCGGTCGCCCTCCTTCTTCCGGAACCTCCACTGCCGCCGCCGCCTCTGATGAT
CCAAACAATAGATCTTCAAAAAGAAAAAAGACGACTTCCAATGTAGGGAGTATAGAGACTGCATTT
CCAGCAGTATATCAAGAAAGGGTCAAGGGAAACTGGCACTATACCACTGCAATTACTGTCATAAA
GACATCTCTGGAATGGTTCGCATTAAGTGTGCAGTGTGTCCTGATTTCGACCTTTGCGTTGAGTGT
TTTTCTGTTGGAGCCGAAGTGACTCCTCATAAAAGCAATCATCCCTACAGGGTTATGGACAATCTG
TCTTTTCCGCTCTTTCATCCAGACTGGAATACAGATGAAGAGATATTACTTCTAGAGGGCATTGAA
ATGTATGGATTTGGGAACTGGACTGAAGTTTCAGAACATGCTGGAACCAAGAGCAAATCTCAATGC
ATTGATCACTATAATGCTGTATACATGGACTCCCCATGCTTTCCTCTCCCAGACATGTCTCATGTT
ATGGGAAAAACAAGAGAGGAGCTCCTTGCAATGGCCAGAGGAAATGTTGAAATGAAGAAAGAAGTC
AGCTCTCATATGGGTTCAAGCAGTGGCAACACATTCTCAGATGCAGTTAAGAAAGCATCTAACGAG
GCCCAGATTAAGGATAAGATTAAAGTGGAAGAACCTCTGTCTGACAGGAGTATTCGAGAGAAAAAA
CCTAGAATTTGCGGAGAGGAAGGACCTTCAATGACAGAGTTAAGTGGCTATAATTTCAAGAGGCAG FIGURE 20 (continued)

GAATTTGAGATTGAATATGATAATGATGCAGAGCAACTACTGGCAGATATGGAATTCAAAGATACT
GACACTGATGCTGAGCTTGACATGAAACTGCAAGTTCTGCGCATTTACTCAAAAAGGCTTGATGAG
AGGAAACGGAGGAAAGATTTTATTTTGGAAAGAAATTTGTTTTACCCTGATGCATTTGAGAAGAAC
ATTTCACCTGAAGAGAAGGAAATATATCAGCGTTACAAGGTCTTCATGAGGTTCCACACAAAAGAA
GAGCATGAAGAATTGATGAAGACTGTTATTGAAGATCATCAGATTATGAAAAGAATACAAGATCTT
CAGGAAGCTCGAGCTGCTGGCTGTCAAACAGCTGGTGAGGCCCAAGGATTTATTGAGCAGAAGAGA
AAGAAGGAAGCCGAAGAAAGTGCCCAAGAGCGAAGGAAAGTATGCAAGCAGGCCCAGCAGGTAAA
CTGTTGCCAAAGCCAAATCATCTTGACAGCAGCCCTCGTGGAGCTGTCAAGTGTTCCACCGTTTTT
CATCCTGGTGGCAACGACTCATCTTCAATGATTGCAAAACAAGCAATTTCAAGCACCCTCGATGAG
TGGGATATTGCTGGATTCCTAGGGGCTGATTTGCTCTCTGAATCTGATAAGCGTCTTTGTTGTGAG
TTGAGAATACTACCTGCACATTATCTCAACATGCTGCACATAATGTCAATAGAGATAACAAAGGGT
ACTGTTACCAACAAAACCGATGCTCATAGCCTGTTCAAGGTGGAATCAAGCAAAGTGGATAGAGTA
TATGATATGTTAGTGAAAAAGGGGATTGCTCTAGCATGA

**SEQ ID NO: 198, protein - *Populus trichocarpa***
MGRSRGNFHSNDEDPTQRSRRKKNAASGDNSESLLAGQGSGDGKRALYHCNYCNKDITGKTRIKCA
MCPDFDLCLECFSVGAEVTPHKSNHPYRVMDNLSFPLICPDWNADEEILLLEGIEMYGLGNWAEIA
EHVGTKSKDTCIEHYNSVYMQSQYFPLPDMSLVVGKNRKELLAMAKGYSEDKKGAAMLGDLTLKEE
SPFSPSRVKVEEMHKGGSSGRLSTLNSEVESAGRPTTTNSAATAANKKASSIARVKDGPNVVKVED
PQVDRNAKGKKPNSSGSEGPSLMELSGYNPKRQEFDPEYDNDAEQLLAEMEFKDTDTEEERELKLR
VLHIYSKRLDERKRRKDFILERNLLQPSPFEKDLTPEERALCRRYDPFMRFHSKEEHEELLQVVIE
EHRMLKRIEELKEAQAAGCRTAAEADRYLEQKRKKEAEENSSRLKDNALVGPSNHGAPNAFIPSES
VRKDSSTRPVGQGSASYANGLDTTGFYETQLLSETEKRLCREIHLPPPVYLKMQEVMTKEIFSGNI
TKKLDAHPLFKIEASKVDRVYDILVKKGIAQP

**SEQ ID NO: 199, DNA - *Populus trichocarpa***
ATGGGTCGTTCTCGTGGGAATTTTCACTCTACTGATGAAGACCCTACTCAGAGATCAAGAAGGAAA
AAGAACGCTGCAAGTGGAGAGAATTCGGAATCTTCATCGGCAGGCCAAGGAAGTAGTGATGGTAAA
AGGGCATTATACCATTGCAATTATTGCAATAAAGACATAACAGGGAAGACCCGTATCAAATGTGCT
GTGTGCCCTGATTTTGACCTATGTTTAGAGTGCTTCTCTGTAGGAGCTGAGGTTACGCCTCATAAA
AGCAATCACCCTTACAGGGTTATGGATAACCTATCTTTCCCACTTATTTGCCCTGACTGGAATGCA
GATGAAGAAATACTGCTTCTAGAGGGAATTGAAATGTATGGATTGGGGAATTGGGCAGAAGTTGCT
GAGCATGTGGGGACAAAGAATAAAGAAACATGTATCAAACACTATAATAGCGTATACTTGCAATCC
CAGTTCTTCCCTCTCCCGGACATGTCTCATGTTGTTGGGAAAAATAGAAAGGAGCTTCTTGCTATG
GCCAAGGGACATAGTGAGGACAAAAAGGTACTTCTATGCTTGGGAGCATACTTTGAAGGAAGAA
TCTCCATTTTCTCCTTCAAGAGTCAAGGTCGAAGAAATGCATAAAGTAGGTTCCTCTGGCCGATTA
TCAACATTAAATTCAGAGTTAGAAACTGCGAGCCGTCCTAATAGCGCAAATTCTGCAGCAACAGCT
GCTAATAAGAAGGCATCAAGCATGGCCCGAATTAATGATGGACCCGGTGTTAAGGTGGAAGATCCT
CAAGTGGACCGAAATTTCAAGGGGAAGAAACCAAGTTCCTCAGGGAGTGAGGGTCCATCATTAATG
GAGTTGAGCGGTTATAATCCCAAGAGGCAGGAGTTTGATCCTGAATATGACAATGATGCTGAGCAG
TTGCTGGCTGAGATGGAATTTAAAGATAATGACACTGAGGAAGAGCGTGAGCTGAAGTTGCGAGTG
CTGCGTATATATTCAAGGAGGCTTGATGAGAGAAAGCGCAGAAAAGATTTCATTCTTGAAAGAAAT
CTACTACATCCAAGTCCTTTCGAAAAGGACTTGACTCCAGAAGAGAGGGCATTATGTCGGCGTTTT
GACCCTTTCATGCGTTTTCATTCCAAGGAAGAGCATGAAGAACTGCTTCGGGCTGTTGTCAAGGAG
CACTGGATGCTGAAAAGGGTCGAAGAGCTGAAGGATGCCCAAGTGGCTGGTTGCCGCACAGCAGTT
GAGGCAGACAGGTATCTTGAGCACAAGAGAAAAATAGAAGCTGAGGAAACTTCCAGGAGACTGAAA
GACAATGCTCAGATTGGTCCTAGCAGTCAGGGTGCTCCCAATGCATTCATGTCTCCAGACTCTGTT
GGGAAGGATTCAAGCACCAGACCTGCAGGACAGGGCTCTTCTAGCTATGCCAATGATTTGGACATA ATGGGCTTTTATGAAACGCAGCTACTGTCTGAAACTGAAAAACGGCTATGCTGCGAGATTCACCTA
CCTCCACCTGTCTACCTCAAGATGCAGGAGGTGATGACCAAAGAGATCTTCAGCGGTAACATCACT
AAGAAATCAGATGCTCACCCCTTGTTCAAGATTGAAGCAAGCAAAGTTGATGGGGTGTATGATATG
CTTGTGAAGAAGGGGATTGCTCAACCTTGA

**SEQ ID NO: 200, protein - *Populus trichocarpa***
MGRSRGNFHSTDEDPTQRSRRKKNAASGENSESSSAGQGSSDGKRALYHCNYCNKDITGKTRIKCA
VCPDFDLCLECFSVGAEVTPHKSNHPYRVMDNLSFPLICPDWNADEEILLLEGIEMYGLGNWAEVA
EHVGTKNKETCIKHYNSVYLQSQFFPLPDMSHVVGKNRKELLAMAKGHSEDKKGTSMLGEHTLKEE
SPFSPSRVKVEEMHKVGSSGRLSTLNSELETASRPNSANSAATAANKKASSMARINDGPGVKVEDP
QVDRNFKGKKPSSSGSEGPSLMELSGYNPKRQEFDPEYDNDAEQLLAEMEFKDNDTEEERELKLRV
LRIYSRRLDERKRRKDFILERNLLHPSPFEKDLTPEERALCRRFDPFMRFHSKEEHEELLRAVVKE
HWMLKRVEELKDAQVAGCRTAVEADRYLEHKRKIEAEETSRRLKDNAQIGPSSQGAPNAFMSPDSV
GKDSSTRPAGQGSSSYANDLDIMGFYETQLLSETEKRLCCEIHLPPPVYLKMQEVMTKEIFSGNIT
KKSDAHPLFKIEASKVDGVYDMLVKKGIAQP

**SEQ ID NO: 201, DNA - *Vitis vinifera***
ATGGGTCGTTCTCGCGCAGTTCTGCATTCTACTGACGATGATCAAGGTTCACACAGATCCAAGAGA
AGAAAGACTGCTTCAACAGCAGACAATTTAGAGGGTGCAACTGCAGGCCAAGGAATGAGTGAGGGG
AAGMGAGCTTCATACCACTGTAATTATTGCAGCAAAGATATCTCAGGAAAGATCCGTACCAAATGT
GTAGTTTGTCCCGATTTTGACCTTTGCATTGAATGCTTTTCCATTGGAGCTGAGGTTACACCTCAY
GTATGCTTTCATCCATATCGGGTCATGGACAATTTATCGTTCCCACTCATTTGTCCTGATTGGAAT
GCAGATGAAGAGATGTTACTTCTGGAGGGAATTGAAATGTACGGACTGGGGAACTGGAGTGAAGTT
TCAGAACATGTTGGAACCAAAAGAAAATCAGAATGTATCGATCACTATGTTGCTATATACATGAAT
TCCCCATGCTTTCCTCTTCCTGACATGTCCCATGTTCTTGGAAAGACTAGGGCTGAGCTCCTTGCC
ATGGCCAGGGGAGAAGATGAAGTCAAGAAGGATCCCCTACACATGGGGAGTTAACTCTGAAAGTG
GAATCTCCCTTATCTGCAAGAGTCAAGTACGGCAAATGCATGCTAAAATGTGTTTCTCTCATCTGT
CAGAGATCCAATCCGACATGGATTTCTAGCAGCACTAAAACATCTGCAGGTGCAGTTAAGAGGGCA
TCTAACATGGCCCAGGTTAAGGATGGTCGTGATAACATTAAAGTGGAAGAAACTCAAACAGACAGA
AGTGTTGGAGAGAAAAAGCCTAGGACCTCGGGGGATGAGGGGCCTTCTGTGACAGAGCTGAGTGGA
TACAATTTCAAGAGGCAAGAGTTTGATGTTGAGTATGATAATGATGCTGAGCAGTTACTGGCTGAT
ATGGAATTCAAGGATGCTGACACTGATGCTGAGCATGAACTGAAACTGCAAGTTCTGCATATTTAT
TCCAAAAGGCTTGATGAGAGGAAACGCAGGAAGGATTTCATATTGGAAAGAAATCTACTTTACCCT
GACCCTTTTGAGAAGAACCTCTCACCTGAAGAGAGGGACGTAAATCAGCGCTTCAAGGTCTTTATG
CGGTTCCACTCAAAAGAAGAACATGAGGAACTGCTTAGGGTTGTGCTCGAGGAACATTGGATTCAG
AAAAGAATACAAGATCTTCAGGACGCCCGAGCTGCTGGCTGCCGTACATCTGCTGAGGCAGAGAGA
TATCTTGAAGAGAAAGGGAAGAAAGAAGCTGAAGAAAGTGCCCAACAAGCAAAGGAAAGTGCTGAG
GCTGGTCCTAGTGGGGGTAAAGTCTTACAGAGGGTGAACACTGCCAAAGGAGAATCTGATGGCAGT
CCTCGGGGAGGTGGAAGAGGTTCTGCAGGTCTAGAACCTGGAATCAAGGACACTTCTTCAACAACT
GCAGGACATGCTATCTTAAGATCCCTAGATGTTTGGGATATCACTGGATTTCCGGGGGAAGATTTA
CTCTCAGAAACTGAGAAACAGCTTTGCAGTGAGATCAGAATCCTCCCTTCACATTATCTCAACATG
CTGCACACCATGTTGACAGAGACGTTAAATGGAAACATCACCAGGAAATCAGATGCCCATGGCCTG
TTCAAGGTTGAACCAAGCAAAGTAGACAAAGTGTACGATATGTTTGTGAAGAAGGGAATTGTTAAG
TCATAG

**SEQ ID NO: 202, protein - *Vitis vinifera***
MGRSRAVLHSTDDDQGSHRSKRRKTASTADNLEGATAGQGMSEGKRASYHCNYCSKDISGKIRTKC
VVCPDFDLCIECFSIGAEVTPHVCFHPYRVMDNLSFPLICPDWNADEEMLLLEGIEMYGLGNWSEV
SEHVGTKRKSECIDHYVAIYMNSPCFPLPDMSHVLGKTRAELLAMARGEDEVKKGSPTHGELTLKV

FIGURE 20 (continued)

ESPLSARVKYGKCMLKCVSLICQRSNPTWISSSTKTSAGAVKRASNMAQVKDGRDNIKVEETQTDR
SVGEKKPRTSGDEGPSVTELSGYNFKRQEFDVEYDNDAEQLLADMEFKDADTDAEHELKLQVLHIY
SKRLDERKRRKDFILERNLLYPDPFEKNLSPEERDVNQRFKVFMRFHSKEEHEELLRVVLEEHWIQ
KRIQDLQDARAAGCRTSAEAERYLEEKGKKEAEESAQQAKESAEAGPSGGKVLQRVNTAKGESDGS
PRGGGRGSAGLEPGIKDTSSTTAGHAILRSLDVWDITGFPGEDLLSETEKQLCSEIRILPSHYLNM
LHTMLTETLNGNITRKSDAHGLFKVEPSKVDKVYDMFVKKGIVKS

**SEQ ID NO: 203, DNA - *Zea mays***
ATGGGGCGGTCGCGAGGGGTGCAGAATTCCGGCGACGACGACACCGTACACAGGTCGAAGCGGAGG
AGGGTCGCATCGGGCGGGGATGCGACGGACTCCGTTTCCGCTGGCATCGGGGGAGCTGGAGAAGGA
GGGGGCAAGAAAGCGCTCTACCACTGCAATTACTGCAACAAGGACATCTCTGGGAAGATACGGATC
AAATGCTCCAAGTGCCCTGACTTCGACCTTTGCGTGGAGTGCTTCTCTGTTGGCGCTGAAGTCACC
CCACATCGCAGCAACCATCCTTACAAAGTCATGGACAACCTGTCTTTCCCACTTATTTGCCCAGAT
TGGAATGCAGACGAAGAAATTCTCCTCCTTGAGGGAATTGAAATGTATGGTCTGGGAAACTGGCTT
GAAGTTGCAGAGCATGTTGGTACCAAGTCTAAGTTACAGTGTATTGATCATTACACAACAGCATAC
ATGAACTCACCTTGTTATCCCCTACCGGATATGTCTCATGTTAATGGCAAGAACAGGAAGGAGCTT
CTAGCTATGGCTAAAGTGCAGGGTGAAAGTAAAAAAGGGACTTCACTGTTGCCTGGAGAGCTGACT
CCTAAGGCTGAATCTCCATTTTCTCCCTCCAGGGTCAAGGTGGAAGATGCACTTGGAGAAGGTCTA
GCAGGTCGATCACCTTCGCACATAGCTGTTGGTGCAAATAAAAAAGCTTCAAATGTGGGACATATT
AAAGATGGGTCTAATGTATCAAAAGTTGAAGATGGTCATGTCGATAGAAGTGTTGGTGTGAAGAAG
CCCAGATATTCTGCAGATGAAGGCCCTTCGTTGACTGAACTGAGTGGATACAATGCAAAGAGACAC
GAGTTTGACCCAGAGTATGATAATGATGCCGAACAAGCGCTTGCTGAGATGGAATTTAAAGAAACT
GATTCAGAAACTGATCGTGAACTGAAACTCCGTGTGCTGCGTATTTATCTGTCCAGGCTTGATGAA
AGAAAAAGGAGAAAAGAGTTCATATTGGAAAGGAATTTATTGTTTCCTAATCCCTTGGAGAAGGAT
CTTACAAATGAAGACAGGGAAGTTTACCATCGGTATAAGGTCTTCATGCGTTTTCTTTCCAAGGAG
GAACATGAAGCCCTTGTTAGGAGTGTCATTGAAGAGCGAAAAATTCGGAGGAGAATTCAAGAACTC
CAGGAATGTCGTTCTGCTGGATGCCGCACACTTGCTGAAGCAAAGATACACATAGAGCAAAAGAGG
AAAAAAGAATACGAGCTGAATGCCCAAAAAGCTAAGGAAAGTAACCACCTTATTGCAAATACTAAA
TTGGTGCAGAAGATGAATCGACCTATGAAGATTGAGTCTGATGGGAATTTGGATCCAAAGAAAGGT
GGTGTTGCGTTAGATTCTCCTAAAACTACAGGACTTACAAGTGTTAAGCAGTGGGATGACTGGGAT
ATAGTTGGTCTTCCTGGGGCAAGCTATTAAGTGCTAGCGAAAAGCTTCTATGTTGCCAGAACAGA
CTGCTACCCAGTCATTACCTGAGAATGCAGGAGGTGCTGATGCAGGAGATATTCAAGGGTAGTGTC
CTAAAGAAGGAAGACGCACACGTCTTGTTTAAGGTTGATCCTACCAAAGTAGATAGTGTTTATGAT
ATGGTAACAAAAAAGCTGGGCAACCATGTGGAGTTGCCTACGGTCTAG

**SEQ ID NO: 204, protein - *Zea mays***
MGRSRGVQNSGDDDTVHRSKRRRVASGGDATDSVSAGIGGAGEGGGKKALYHCNYCNKDISGKIRI
KCSKCPDFDLCVECFSVGAEVTPHRSNHPYKVMDNLSFPLICPDWNADEEILLLEGIEMYGLGNWL
EVAEHVGTKSKLQCIDHYTTAYMNSPCYPLPDMSHVNGKNRKELLAMAKVQGESKKGTSLLPGELT
PKAESPFSPSRVKVEDALGEGLAGRSPSHIAVGANKKASNVGHIKDGSNVSKVEDGHVDRSVGVKK
PRYSADEGPSLTELSGYNAKRHEFDPEYDNDAEQALAEMEFKETDSETDRELKLRVLRIYLSRLDE
RKRRKEFILERNLLFPNPLEKDLTNEDREVYHRYKVFMRFLSKEEHEALVRSVIEERKIRRRIQEL
QECRSAGCRTLAEAKIHIEQKRKKEYELNAQKAKESNHLIANTKLVQKMNRPMKIESDGNLDPKKG
GVALDSPKTTGLTSVKQWDDWDIVGLPGAKLLSASEKLLCCQNRLLPSHYLRMQEVLMQEIFKGSV
LKKEDAHVLFKVDPTKVDSVYDMVTKKLGNHVELPTV

**SEQ ID NO: 205, DNA - *Zea mays***
ATGGGGCGGTCGCGAGGGGTGCTGAGTTCCGGCGACGACGACACCGGGCACAGGTCGAAGCGGAGG
AGAGTCTCGTCGGGCGGGGATGCGACGGACTCCATTTCAGCCTCCATCGGGGGAGCTGGAGAGGGA

FIGURE 20 (continued)

```
GGGGGCAAGAAGGCGCTCTATCACTGCAACTACTGCAACAAGGACATCTCCGGGAAGATACGGATC
AAGTGCTCCAAGTGCCCTGACTTCGACCTTTGCGTGGAGTGTTTCTCTGTCGGCGCTGAAGTCACC
CCGCACCGCAGCAACCATCCTTACAAAGTCATGGACAACTTGTCTTTCCCACTTATTTGCCCGGAT
TGGAATGCAGATGAAGAAATTCTCCTCCTTGAGGGAATTGAAATGTATGGTCTGGGAAACTGGCTT
GAAGTTGCAGAGCATGTTGGTACCAAGTCTAAGTTACAGTGTATTGATCATTACACATCAGCATAC
ATGAACTCACCTTGTTATCCCCTCCCGGATATGTCTCATGTTAATGGCAAGAATAGGAAGGAACTT
CTAGCTATGGCTAAAGTACAGGGTGAGAGTAAAAAAGGGACTTTGCTGTTACCTGGAGAACTCACT
CCTAAGGTTGAATCTCAATTTTCTCCCTCCAGGGTCAAGGTGGAAGATGCACTTGGAGAAGGTCCA
GCAGGTCGATCACCTTCACACATGGCTGTTGGTGCAAATAAAAAAGCTTCAAATGTGGGACATATT
AAGGATGGCGCTACTGTATCAAAAGTCGAAGATGTTCATGTAGATAGAAGTGTTGGTGTGAAGAAG
CCCAGATATTCTGCAGATGAAGGCCCTTCGTTGACTGAACTGAGTGGATACAATGCAAAGAGACAT
GAGTTTGACCCAGAATACGATAATGATGCCGAACAAGCTCTTGCTGAGATGGAATTTAAAGAAACT
GATTCGGAAACTGATCGTGAACTGAAACTCCGTGTGCTGCGTATTTACCTCTCCAGGCTTGATGAA
AGAAAAAGAAGAAAGGAGTTCATATTGGAAAGAAATTTGTTGTTCCCTAATCCCTTGGAGAAGGAT
CTTACGAGTGAAGACAGGGAACTTTACCATCGCTATAAAGTCTTCATGCGTTTTCTTTCTAAGGAG
GAACATGAAGCCCTCGTTAGGAGTGTTATTGAGGAGCGAAAAATTCGGAGGAGAATTCAAGAACTC
CAGGAATGCCGTTCTGCTGGATGCCGCACACTGGCTGAAGCAAAGATACACATAGAGCAAAAGAGG
AAAAAAGAATACGAGCTGAATGCGCAAAAAGCTAAGGATAGCAGTCAACTTAATGCAAATAATAAA
TCAGTACAAAAGATGAATCGACCTATGAAAATTGAGTCCGATGGGAATTTGGATCCAAAGAAAGGT
GGTGCTGGCTTGGATTCTCCTAAGACAACAGGACCTACAAGTGTTAAGCAGTGGGATGACTGGGAT
ATAGTTGGTCTTCCTGGGGCAGAGCTATTAAGTGCTAGCGAAAAGCTTCTATGCTGTCAGAACAGA
TTGCTACCCAGCCATTACCTGAGAATGCAGGAGGTGCTGATGCAGGAGATATTCAAGGGTAGCGTC
CTAAAGAAGGAAGACGCCCACGTCTTATTTAAGGTCGATCCTACCAAAGTAGATAGTGTTTATGAT
ATGGTATCTAAAAAACTGGGCAACCATGAGGAGGCCCCAACCGTCTAG
```

**SEQ ID NO: 206, protein - *Zea mays***
MGRSRGVLSSGDDDTGHRSKRRRVSSGGDATDSISASIGGAGEGGGKKALYHCNYCNKDISGKIRI
KCSKCPDFDLCVECFSVGAEVTPHRSNHPYKVMDNLSFPLICPDWNADEEILLLEGIEMYGLGNWL
EVAEHVGTKSKLQCIDHYTSAYMNSPCYPLPDMSHVNGKNRKELLAMAKVQGESKKGTLLLPGELT
PKVESQFSPSRVKVEDALGEGPAGRSPSHMAVGANKKASNVGHIKDGATVSKVEDVHVDRSVGVKK
PRYSADEGPSLTELSGYNAKRHEFDPEYDNDAEQALAEMEFKETDSETDRELKLRVLRIYLSRLDE
RKRRKEFILERNLLFPNPLEKDLTSEDRELYHRYKVFMRFLSKEEHEALVRSVIEERKIRRRIQEL
QECRSAGCRTLAEAKIHIEQKRKKEYELNAQKAKDSSQLNANNKSVQKMNRPMKIESDGNLDPKKG
GAGLDSPKTTGPTSVKQWDDWDIVGLPGAELLSASEKLLCCQNRLLPSHYLRMQEVLMQEIFKGSV
LKKEDAHVLFKVDPTKVDSVYDMVSKKLGNHEEAPTV

SEQ ID NO: 207, protein - Artificial sequence - Zinc finger ZZ type
KPGLYCCNYCDKDLSGLVRFKCAVCMDFDLCVECFSVGVELNRHKN

SEQ ID NO: 208, protein - Artificial sequence - SANT DNA bindin domain
VTSDWNADEEILLLEAIATYGFGNWKEVADHVGSKTTTECIKHFNSAYM

SEQ ID NO: 209, protein - Artificial sequence - calcium binding EF hand
DNDAEQLLADMEF

FIGURE 20 (continued)

SEQ ID NO: 210, protein - Artificial sequence - SWIRM
PRIYSGLDTWDVDGLLGADLLSETEKKMCNETRILPVHYLKMLDILTREIKKGQIKKKSDAYSFFK
VEPSKVDRVYDMLVHKGIGDST

SEQ ID NO: 211, DNA - Artificial sequence - primer 1
GGGGACAAGTTTGTACAAAAAAGCAGGCTTAAACAATGGGTCGTTCGAAACTAGC

SEQ ID NO: 212, DNA - Artificial sequence - primer 2
GGGGACCACTTTGTACAAGAAAGCTGGGTCATGTTAGGACCATGAAGCTATG

SEQ ID NO: 213, DNA - Oryza sativa
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGGTGGATGACGGGTGGGCCCGGAGGAGGTCCGGCCC
CGCGCGTCATCGCGGGGCGGGGTGTAGCGGGTGCGAAAAGGAGGCGATCGGTACGAAAATTCAAAT
TAGGAGGTGGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGGCCTTCTCGCAGG
ATTCAGCC

SEQ ID NO: 214, DNA - Oryza sativa
AAAACCACCGAGGGACCTGATCTGCACCGGTTTTGATAGTTGAGGGACCCGTTGTGTCTGGTTTTC
CGATCGAGGGACGAAAATCGGATTCGGTGTAAAGTTAAGGGACCTCAGATGAACTTATTCCGGAGC
ATGATTGGGAAGGGAGGACATAAGGCCCATGTCGCATGTGTTTGGACGGTCCAGATCTCCAGATCA
CTCAGCAGGATCGGCCGCGTTCGCGTAGCACCCGCGGTTTGATTCGGCTTCCCGCAAGGCGGCGGC
CGGTGGCCGTGCCGCCGTAGCTTCCGCCGGAAGCGAGCACGCCGCCGCCGCCGACCCGGCTCTGCG
TTTGCACCGCCTTGCACGCGATACATCGGGATAGATAGCTACTACTCTCTCCGTTTCACAATGTAA
ATCATTCTACTATTTTCCACATTCATATTGATGTTAATGAATATAGACATATATATCTATTTAGAT
TCATTAACATCAATATGAATGTAGGAAATGCTAGAATGACTTACATTGTGAATTGTGAAATGGACG
AAGTACCTACGATGGATGGATGCAGGATCATGAAAGAATTAATGCAAGATCGTATCTGCCGCATGC
AAAATCTTACTAATTGCGCTGCATATATGCATGACAGCCTGCATGCGGGCGTGTAAGCGTGTTCAT
CCATTAGGAAGTAACCTTGTCATTACTTATACCAGTACTACATACTATATAGTATTGATTTCATGA
GCAAATCTACAAAACTGGAAAGCAATAAGAAATACGGGACTGGAAAAGACTCAACATTAATCACCA
AATATTTCGCCTTCTCCAGCAGAATATATATCTCTCCATCTTGATCACTGTACACACTGACAGTGT
ACGCATAAACGCAGCAGCCAGCTTAACTGTCGTCTCACCGTCGCACACTGGCCTTCCATCTCAGGC
TAGCTTTCTCAGCCACCCATCGTACATGTCAACTCGGCGCGCGCACAGGCACAAATTACGTACAAA
ACGCATGACCAAATCAAAACCACCGGAGAAGAATCGCTCCCGCGCGCGGCGGCGACGCGCACGTAC
GAACGCACGCACGACGCCCAACCCCACGACACGATCGCGCGCGACGCCGGCGACACCGGCCGTCC
ACCCGCGCCCTCACCTCGCCGACTATAAATACGTAGGCATCTGCTTGATCTTGTCATCCATCTCAC
CACCAAAAAAAAAAGGAAAAAAAAACAAAACACACCAAGCCAAATAAAAGCGACAA

FIGURE 20 (continued)

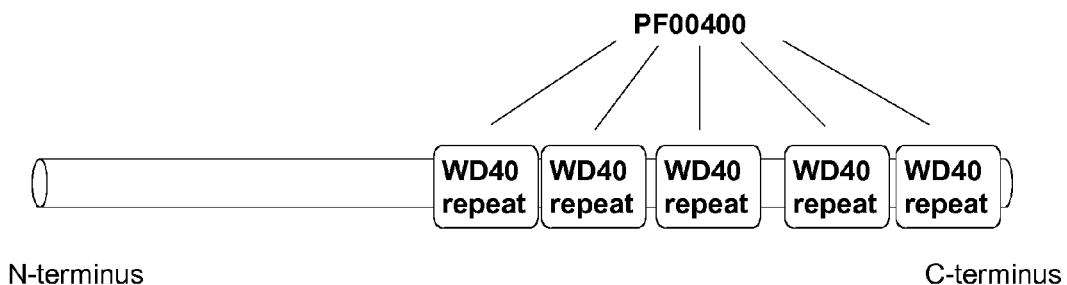
FIGURE 21
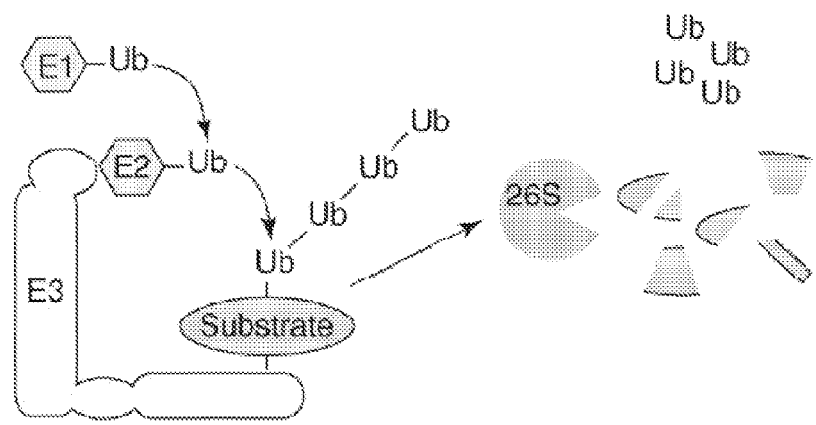
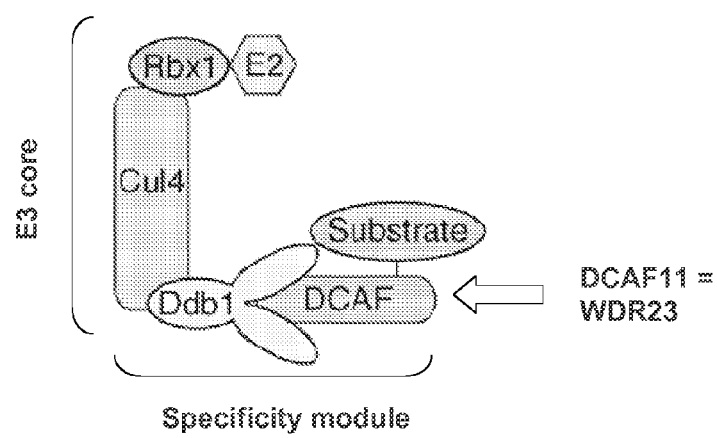
FIGURE 22

```
BLADE i
Glyma_WDR23 LIKE           (265) HLIFSGSDDSFIKVWDRRCFV
Pruar_WDR23 LIKE           (268) HLIYSGSDDNLCKVWDRRCFN
Horvu_WDR23 LIKE II        (258) NLLYSGSDDNLCKVWDRRCLV
Triae_WDR23 LIKE II        (257) NLLYSGSDDNLCKVWDRRCLV
Sacof_WDR23 LIKE II        (261) NVLYSGSDDSFCKVWDRRCLS
Zeama_WDR23 LIKE II        (262) NVLYSGSDDSLCKVWDRRCLS
Orysa_WDR23 LIKE           (266) HLIYSGSDDNLCKVWDRRCLS
Triae_WDR23 LIKE           (263) NLLYSGSDDNLCKVWDRRCLS
Zeama_WDR23 LIKE           (266) HLIYSGSDDTLCKVWDRRCLS
Helan_WDR23 LIKE           (280) NLIYSGSDDNLCKVWDRRSIR
Lyces_WDR23 LIKE           (280) HLIYSGSDDNLCKVWDRRCFR
Liter_WDR23 LIKE           (270) HLIYSGSDDNLCKVWDRRCFN
Glyma_WDR23 LIKE II        (161) HLIYSGSDDSFCKVWDRRCLI
Medtr_WDR23 LIKE           (282) HLIYSGSDDSFCKVWDRRCLN
Arath_WDR23 LIKE           (285) HLILSGSDDNLCKVWDRRCFI
Linus_WDR23 LIKE           (283) HLIYSGSDDNLCKVWDRRCFI
Vitis_WDR23 LIKE           (282) HLIYSGSDDSLCKVWDRRCFI
Pinra_WDR23 LIKE           (285) HIIYSGSDDTYCKVWDRRCLS
Aqufo_WDR23 LIKE           (281) NLIYSGSDDNLCKVWDRRCLR
Poptr_WDR23 LIKE           (281) HLIFSGSDDNLCKVWDRRCFI
Homsa_WDR23                (295) QILFSGGDDAICKVWDRRTMR
Aspn_LEC14B                (408) HILYSGSDDTTLRVWDRRSMG
Consensus                  (411) HLIYSGSDDNLCKVWDRRCLX
DxR motif                                        DxR BLADE i + 1
Glyma_WDR23 LIKE           (311) RYLISNGKDQTTKLWDIRKMS
Pruar_WDR23 LIKE           (314) RYFISNGKDQTTQLWDIRKMS
Horvu_WDR23 LIKE II        (303) RYLISNCKDQTIKLWDVRKMS
Triae_WDR23 LIKE II        (302) RYLISNCKDQTIKLWDIRKMS
Sacof_WDR23 LIKE II        (306) RYFISNCKDQRIKLWDIRKMS
Zeama_WDR23 LIKE II        (307) RYFISHCKDQRIKLWDIRKMS
Orysa_WDR23 LIKE           (311) RCFISNGKDQAIKMWDIRKMT
Triae_WDR23 LIKE           (308) RCFISNGKDQAIKMWDIRKMT
Zeama_WDR23 LIKE           (311) RSFISNGKDQAIKLWDIRKMM
Helan_WDR23 LIKE           (326) RYFISNGKDQTIKLWDIRKMS
Lyces_WDR23 LIKE           (326) RYFISNSKDQSIKLWDIRKMS
Liter_WDR23 LIKE           (316) RYFISNGKDQTIKLWDIRKMS
Glyma_WDR23 LIKE II        (207) RYFISNGKDQTIKLWDIRKMS
Medtr_WDR23 LIKE           (328) RYFISNGKDQTIKLWDIRKMS
Arath_WDR23 LIKE           (331) RYFISNGKDQTIKLWDIRKMS
Linus_WDR23 LIKE           (329) RYLISNGKDQTIKLWDIRKMA
Vitis_WDR23 LIKE           (328) RHLISNSKDQSIKLWDIRKMS
Pinra_WDR23 LIKE           (331) RYFISNGKDQTIKLWDIRKMG
Aqufo_WDR23 LIKE           (327) RYFISNGKDQAIKLWDIRKMS
Poptr_WDR23 LIKE           (327) RYFISNGKDQTIKLWDIRKMA
Homsa_WDR23                (342) RYLISNSKDQTIKLWDIRRFS
Aspn_LEC14B like           (453) RYVLSNGKDQSMKLWDLRKMM
Consensus                  (458) RYFISNGKDQTIKLWDIRKMS
DxR motif                                        DxR
```

FIGURE 23

```
                 1                                                                           75
Aqufo_WDR23   (1) ------MFVTASGVDIDEMGYAMSRLEIESELFDGGNTVHEASSSTR----PGKLFPKVDDEISQLTNLRSGPNDRL
Brana_WDR23   (1) ------MFSGPSDSDTDEMGYAMSRLEIESDLCDAGKGYYGVGSSSGSSHRSSERLGDLDNEISQVTKLKSCPHERF
Arath_WDR23   (1) ------MFFGPSEFDADEMGYAMSRLEIESDLCDTGKDVCGVGSSSGS-HRSSEHLADLDHEISQVTKLKSSPHQRY
Helan_WDR23   (1) ------MYSRGWTTLIGDMGYALSRLEIDPDYSDNGS--VGDDNDSHQ----SSSQNDVDPEVAQLTKLKSAPHDGL
Linus_WDR23   (1) ------MFFVA----STDGMGYAMSRLEIESQLCDEEETVNEVGGGSQQHKSLNKSVEKLDHEVAQDTNLKSQPHRRL
Liter_WDR23   (1) ---------------MGYAMSRFETDVSVIFSSSSDSETSHDS----LINKPVKNLDHEIAQLTRLRSAPHENL
Lyces_WDR23   (1) ------MYFDFLHPESIEDMGYSLSKLEVDTGLFDGSSSNHGVASSVHH----ERPTNYLDHEISQLTKLRSGPHENL
Medtr_WDR23   (1) ------MYAISGALYVDQMGYAMSRLDVDSSDTEDGNAILEDSSTG----KAKKAFENLDNEIAQITKLKSTPHQLL
Orysa_WDR23   (1) ---------------MGYGMSRMEEEYSEHEDQNN---GGSN----SQVNNEFLNTHNDIFHMTQIRSGPSESL
Pinra_WDR23   (1) MNTAMHFGAGWRSIAEMGYTMSRLEIEPESCEDEKSLDGVGNSQG----PNELPRCLDHELAHLTNLKSRPHEHL
Poptr_WDR23   (1) ------MYFFARRTSVDEMGYAMSRLETESELCDGGKTIPEAGSS----KRASNWLNNLDHEIAQVTKLKSSPHKQL
Triae_WDR23   (1) ---------------MGYGMSRLHEGYSEPEGLNS---DGSSS----VEVNNDFSKLHNDIFHMTRLRSGPSE--
Vitis_WDR23   (1) ------MYFTASEGAANEMGYAMSRLELDSDFCDAGKDIHGNDNTER----LNKELNHLDHEISQLTKLRSGPHECL
Zeama_WDR23   (1) ---------------MGYGMSRLDDEYYEAEGQNT---GGSGS----VQVNDEFATLHNDIFHMTRMRSGLTES-
Glyma_WDR23   (1) ---------------MSWLNKNKSTCSDGSANNESSSSGI----VGERDNHLDHEIAQLTKLRSSPHELL
Horvu_WDR23 II (1) ---------------------MAAAGRLRGRRRAQKEVE----RELEPFTIEEEVSHLTRALSEPCPGT
Pruar_WDR23    (1) ---------------MSYRTRFGKDNSACDSGNAVEGSGSSKG----PNEVSNDFDHEIAQLTKHRSRPHQLL
Sacof_WDR23 II (1) ---------------------MRGVRRSARGESSRKAAADRD----REVERFTLCAKMSHLTRTTSEPCRRA
Triae_WDR23 II (1) ---------------------MAAAGRLRGRR-RTKEVE----REPEPFTIEEEVSHLTRVRSEPCPGT
Zeama_WDR23 II (1) ---------------MQGRMRGARRSARGESSRKAAG----REVEPFTLCGEMSHLTRATSEPCRRA Consensus     (1)                 MGYAMSRLE E      DGS      GSS              LD EISQLTKLRS PHE L
```

```
                         76                                                                                              150
Aqufo_WDR23      (68)  HQLVPGKQ-QLPVSPVRMLAGRESNYSGKG-RFSSADRCHMLSRYLPVNGPWLVDQTTSRAYVSQFSADGSLFIA
Brana_WDR23      (72)  SRQVPGRH-QLPVSTVKMLAGRESNFSGRGGRFSSADRCHILSRYLPVKGPWLVDQMDSRAYVSQFSTDGSLFIA
Arath_WDR23      (71)  SREVPGRH-QLPVSTVRMLAGRESNFSGRG-RFSAADCCHMLSRYLPTKGPWLVDQMDSRAYVSQFSTDGSLFIA
Helan_WDR23      (66)  KRVLPRRG-EFDVSPVKMLAGREGNYSGRG-KFSLADRCHMLNKYLPVKGPSIVDQLTTRAYVSQFSKDGSLFVA
Linus_WDR23      (69)  EKEIPGKR-QFPVSPVKMLAGREGNFSGRG-RFSRADRCHMLSRYLPADGPWLVDRMNSRAYVSQFSSDGTLFVA
Liter_WDR23      (56)  SRDLLVKR-VLPLSTMKMLAGREANVSGRG-RFSSADCCHVSRHLPVNDPCVVDQMTSRVYLSQFSTDGSLFVA
Lyces_WDR23      (69)  SRILPGKK-EVPVSAFKMLAAREANISGRG-RFSKADCCHVLSKYLPVSGPWIVDQMETRAYVSQFSADGSLFVA
Medtr_WDR23      (68)  VHDGSGRK-ELPVSPVKMLAGRESNCSGRG-RFSSADRCHLLSRYLPVNGPWPIDQMPSRAYVSQFSADGSLFVA
Orysa_WDR23      (53)  -RKSIGTS-KDVISTTRLLSGREINSSGNG-KFSSVDRAFLLGRYLPVDGPEIVDRMDSRAYVSQFSADGSLFVA
Pinra_WDR23      (72)  IRDFPGRR-ALPVSTVKMLAGRECNYSRRG-RFSSADCCHMLSRYVPVNGPSPLDQMNSRAYVSQFSADGSLFVA
Poptr_WDR23      (68)  AELVPGMH-KSSVSTVKMLVGREANYSARG-RFSAADRCHMLSRYLPVNGPWLVDQMSTRAYVSQFSADGSLFVA
Triae_WDR23      (52)  ---SIRKS-MDRVSVTRLLRGREVNSSGNG-KFSPVDRAFVLGHYLPVDGPETVDTMDSRAYVSQFSADGSLFVA
Vitis_WDR23      (68)  SQIIPGKR-DSPVSTVKMLAGREGNYSGRG-RFSSADCCHMLSRYLPVNGPWLVDQMTSRAYVSQFSADGTLFVA
Zeama_WDR23      (53)  -YKSMGTN-RGIISTAKLLSRREIDCSGKG-MFSSGDRAFVLGRHVPMNNPELLDRMDSRAYVSQFSADGSLLIA
Glyma_WDR23      (52)  GRVVPGKM-RLPASTVRMLVGREGNYSGRG-RFSSADGCHVLSRYLPTKGPWIVDRMKSRAYVSQFSADGSLLVA
Horvu_WDR23 II   (45)  RAAVRGARRKRGVSAFDMLSSRESGRSGGG-GFCSADRAYAAGRHLPAVGPWCVEDMDSEAYVSQFSSDGSLLVA
Pruar_WDR23      (55)  SQDMPGKS-RLLIVSTMKMLVGRESNHSGRG-RFSSADGCHVLSRYLPINGPWGVDQSTSPAYVSQFSNDGLFFVA
Sacof_WDR23 II   (48)  RGAAPALR-KRPFSAFELVSAREAGRAGGA-GFSAADRAYVGRQHIPTKGPWGVDDVDSEAYVSQFSADGSLLIA
Triae_WDR23 II   (44)  RAAIHGAKRKRDVSAFEMLSSRESGLSGGG-GFCSADRAYAAGKHLPSEGPWCVEDMDSEAYVSQFSSDGSMLVA
Zeama_WDR23 II   (49)  RGAAFARR-ARPFSAYELVSAREAGRAGGA-GFSAADRAYLGRQHIPTKGPWGVDDVESEAYVSQFSADGSLLIA Consensus        (76)  VPGKR    PVSTVKMLAGRESN SGRG RFSSADRCHMLSRYLPV  GPWLVDQMDSRAYVSQFSADGSLFVA
                                                                     Beginning of
                                                                     Conserved Domain
```

```
                      151                                                                                           225
Aqufo_WDR23     (141) GFQGSDIRIYNVDRGWKVQKNILAKSLRWTVTDTSLSPDQRHLVYTSMSPIVHIVNVGSATTESLANITEVHEGL
Brana_WDR23     (146) GFQGSHIRIYNVEKGWKVQKDILAKSLRWTVTDTSLSPDQRNLVYASMSPIVHIVDVSGTTESHANVTEIHDGL
Arath_WDR23     (144) GFQGSRIRIYNVEKGWKVQKDILAKSLRWTVTDTSLSPDQRNLVYASMSPIVHIVDVGSSTESHANVTEIHDGL
Helan_WDR23     (139) AFQGSQIKIYNAEMGWKLHKKIVAESFNWTVTDTSISPDKRFLIYSTLSPIVNIGSAGTESHANVTDIHEGL
Linus_WDR23     (142) GFQGSHIKVYNVEKGWKVQKDIIARSLRWTVTDTSLSPDQRFLVYASMCPIVHIVNIASSTTESVANVTEIHDGL
Liter_WDR23     (129) GFQGCHIRIYNVDKGWKVQNDIIAKCVRWTITDASLSPDQKFLAYASLTPIAHIVKFGSAATESHANVTDIHDGL
Lyces_WDR23     (142) AFQGSHIRIYNVERGWKVHKNIHAKSLRWTVTDTSLSPDQRHLVYATMSPIVHIVDVGSAASESVANITEIHDGL
Medtr_WDR23     (141) GFQGNHIKIYNVEKGWKVQKNILTKSLRWTITDTSLSPDQSHLVYASMSPIVHIVNVGSSETESLANVTEIHDGL
Orysa_WDR23     (125) GFQGSHIRIYDVDKGWKVHRDIHARSLRWTISDASLSPDQQFLVYSSLAPIIHIVNVGTAAKQSYANITDIHDGL
Pinra_WDR23     (145) GFQGSHIRIYDVDKGWKCQKNILTKSLRWTITDTSLSPDQRYLVYASMSPIVHIVDIGSAAMDSLANITEIHEGL
Poptr_WDR23     (141) GFQGSYIRIYNVEKGWKVQKNILAKSLRWTVTDTSLSPDQRHLVYASMSPIVHIVDAGSAETESLANVTEFHDGL
Triae_WDR23     (122) GFQGSHIRIYDVDKGWEIHKDIHARSLRWTISDAALSPDQRFLVYSSLAPIIHIVNVGTASRESYANVTDIHDGL
Vitis_WDR23     (141) GFQGSHIRIYNVDRGWKVQKNILAKSLRWTVTDTSLSPDQRHLVYASMSPIVHIVNIGSAATESLANITEIHDGL
Zeama_WDR23     (125) GFQGSHIRIYDVDRGWSIHKDIHARCLRWTISDVSLSPDQRYLAYSSLAPIIHIVNVNAARESYANVTDIHDGL
Glyma_WDR23     (125) GFQGSHIRIYDVDQGWKVKKDISARKLRWTVTDTSLSPDQLYLVYASMSPIIHIVTVGSGTTESIANVTEIHYGL
Horvu_WDR23 II  (119) GFRGSRIRVYDVDKGWKVHKNISCRSMRWTVSDIALSPDQRYLAYSSLSPIVHIVNVQNAGRESYANVTEIHEGL
Pruar_WDR23     (128) GFQGGHIRIYNVDKGWKVQKDILTKSLRWTITDTSLSPDQRYLVYASMTPIVNIVNVGSSMTESLANVTEIHEGL
Sacof_WDR23 II  (121) GFRGSRIRVYDAEKGWKIHKDISCQMVHWTVSDIALSPDQRFLAYASLSPTVHIVNVQSAGKESHANITEIHEGL
Triae_WDR23 II  (118) GFRGSRIRVYDVDRGWKVHKNISCRSMRWTVSDIALSPDQRYLAYSSLSPIVHIVNVQNAGRESDANVTEIHDGL
Zeama_WDR23 II  (122) GFRGSRIRVYDAEKGWKIHKDISCRSVHWTVSDIALSPDQRFLAYASLTPIVHIVNVQNAGKESHANITEIHEGL Consensus       (151) GFQGSHIRIYNVDKGWKVQKDILAKSLRWTVTDTSLSPDQRFLVYASMSPIVHIVNVGSAATESHANVTEIHDGL
```

```
                        226                                                                                           300
Aqufo_WDR23    (216)   DFSAADGG-YSFGIFSVKFSTDGRELVAGSSDDSIYVYDLEANKLSLRIAAHMADVNTVTFADESGNLIYSGSDD
Brana_WDR23    (221)   DFSSEEDGGYSFGIFSVKFSTDGRELVAGSSDDSIYVYDLEANRVSLRTVAHTSDVNTVCFADESGHLILSGGDD
Arath_WDR23    (219)   DFSSDEDGGYSFGIFSVKFSTDGRELVAGSSDDSIYVYDLEANRVSLRTVAHTSDVNTVCFADESGNLILSGSDD
Helan_WDR23    (214)   EFAADDEEGYAFGIFSVKFSSDGRELVAGSSDDSIYVYDLEAKRFSLRIQAHTSDVNSVCFADEASNLIYSGSDD
Linus_WDR23    (217)   DFSDEDDGGYAFGIFSVKFSTDGRELVAGSSDDAICVYDLETNKLSLRILAHTSDVNTVCFADESGHLIYSGSDD
Liter_WDR23    (204)   DFSSNDDGGYSFGVFSIKFSTDGREIVAGTSDESICVYDLEADRLSLRISAHESDVNSVCFADESGHLIYSGSDD
Lyces_WDR23    (217)   LLSTDNDD---FGIFSVKFSTEGREVVAGSSDDAIYVYDLEANKLSLRISAHNSDVNSVCFADESGHLIYSGSDD
Medtr_WDR23    (216)   DFSSNDDGGYSFGIFSLKFSTDGKELVAGTSGDSIYVYDLETNKVSLRILAHTADVNTVCFADETGHLIYSGSDD
Orysa_WDR23    (200)   DFSQHEDVRYTFGIFSVKFSSDGRELVAGSNDDSIYVYDLVANKLTLRLPAHHSDVNTVAFADETGHLIYSGSDD
Pinra_WDR23    (220)   DFSAD-SGPYSFGIFSVKFSSDGRELVAGSNDDSIYVYDLVANKLSLRIPAHESDVNTVCFADESGHIIYSGSDD
Poptr_WDR23    (216)   DFSSG-DGGYSFGIFSVKFSTDGRELVAGSNDDSIYVYDLEONKLSLRILAHTSDVNTVCFADESGHLIFSGSDD
Triae_WDR23    (197)   DFSEHEDVRYSFGLFSVKFSTDGRELVAGSNDDSIYVYDLQTNKVTLRLPAHTSDVNTVAFADESGNLLYSGSDD
Vitis_WDR23    (216)   DFSAADDEGYSFGIFSVKFSTDGRELVAGSSDDSIYVYDLEANKLSLRISAHTSDVNTVCFADESGHLIYSGSDD
Zeama_WDR23    (200)   DFSQHEDVQYSFGIFSVKFSTDGRELVAGSNDDSIYVYDLHANKLTLRLSAHTSDVNTVAFADETGHLIYSGSDD
Glyma_WDR23    (200)   NFSSD-NGDDEFGIFSVKFSTDGRELVAGTSDCSICVYDLGADKLSLRIPAHQSDVNTVCFADESGHLIFSGSDD
Horvu_WDR23 II (194)   EFCD---DDEYSFGIFSVKFESKDGREVVVGNNDCSIYVYDLGANKVSDRIRAHMGDVNTVTFADESNLLYSGSDD
Pruar_WDR23    (203)   DFSVG-GDEDEFGIFSVKFSVRFSTDGRELVAASRDASIYVYDLQANKVNLRIPAHSSDVNTVCFADETGHLIYSGSDD
Sacof_WDR23 II (196)   DLTGG-DEDEDEFGIFSVKFSKDGKEIVVGNNERSIYVYDLATNKVSARIRAHKADVNAVTFADESGNVLYSGSDD
Triae_WDR23 II (193)   EFCD---DDEYSFGIFSVKFSKDGREVVGNNDCSIYVYDLGANKVSDRIRAHTSDVNTVTFADESGNLLYSGSDD
Zeama_WDR23 II (197)   DLTGG-DEDEDEFGIFSVKFSKDGKEVVVGNNEKSIYVYDLSANKVSARIRAHKADVNAVTFADETGNVLYSGSDD Consensus      (226)   DFSS DD  YSFGIFSVKFSTDGRELVAGSSDDSIYVYDLEANKLSLRI AHTSDVNTVCFADESGHLIYSGSDD
               000000000PF00400000000000000xxxxxxxxxxxxxxxxxxxxxxxxxxxxxxx000xxxxxxxxxxxxxxxxxxxxxxxxxxxxxxxx Predicted WD40                          Predicted WD40
                       repeat PF00400:                         repeat PF00400:
                             I                                       II
```

FIGURE 24 (continued)

```
                            376                                                                                            450
Aqufo_WDR23      (363) YRWMEYPTEARKLKHPCDQSLATYKGHSVLRTLIRCYFSPAYSTGQKYIYTGSNDCVYIYDLVSGAQVARLD-H
Brana_WDR23      (370) YRWMDYPSEARDLKHPYDQSVSTYKGHSVLRTLIRCYFSPAHSTGQKYIYTGSNDSSVYIYDLESGDKAAVLK-H
Arath_WDR23      (368) YRWMDYPTEARDLKHPLDQSVSTYKGHSVLRTLIRCYFSPAHSTGQKYIYTGSNDSSVYIYDLVSGDKVAVLK-H
Helan_WDR23      (362) YRWMDYLLRARDVKHPSDQSVATYKGHSVLRTLIRCYFSPEYSTGQRYIYTGSHDCVYVYDLVFGARVARLV-H
Linus_WDR23      (365) YRWMDYPPPARDLKHPCDLSVATYKGHSVLRTLIRCYFSPTYSTGQKYIYTGSHDANVYIYDLVTGEVAGVLK-H
Liter_WDR23      (352) YRWMEYPQEARDLKHPSDLSGATYKGHSVLCTLIRCYFSPDYSTGQKYIYTGSHDACVYIYDLVTGDQVSTLQ-Y
Lyces_WDR23      (362) YRWMDYPAQARDVKHPYDQSISTYKGHSVLRTLIRCYFSPEYSTGQKYIYTGSHDACVYIYDLVSGEQVAKLQ-H
Medtr_WDR23      (366) YRWMDYPPQAKDLNHPCDQSVATYRGHSVLRTLVRCFFSPAFSTGQKYIYTGSHNACVYVYDLVSGAQVATLK-H
Orysa_WDR23      (346) YRYSRYPQQYKQLKHPHDQSIATYWGHSVLRTLIRCYFSPAYSTGQKYIYTGSYDSSVCIYDLVSGSQVAKLKGY
Pinra_WDR23      (366) YRWMDYPPRARDSKHPFDLSVATYKGHSVLRTLIRCYFSPVHSTGQKYIYTGSHDCVYIYDLVTGAQVAALK-H
Poptr_WDR23      (363) YRWMDYPYEARDLKHPCDQSVATYRGHSVLRTLIRCYFSPVYSTGQKYIYTGSHDSCVYIYDLVTGELVSLLQ-H
Triae_WDR23      (343) YRYSRYPQQYKQQKHPHDQSVATYRGHSVLRTLIRCYFSPTYSTGQKYIYTGSYDASVCIYDLVSGSQVAKLQGH
Vitis_WDR23      (364) YRWMDYPTQARELKHPCDQSLSTYKGHSVLRTLIRCYFSPSYSTGQKYIYSGSSDSCIYIYDLLTGAQVATLE-H
Zeama_WDR23      (346) YRYSRYPHQHKQLKHPHDQSIATYRGHTVLRTLIRCYFSPSYSTGQKYIYTGSYDSNVCIYDLVSGSQVAKLK-W
Glyma_WDR23      (346) YRWMDYPEYARNLKHPHDQSLATYRGHSVLRTLIRCYFSPSYSTGQKYIYTGSSDSVHIYDLVSGAQVAKLD-H
Horvu_WDR23 II   (338) YRWMSLPSHARYKHPDLSLATYRGHSVLRTLIRCYFSPMHSTGQRYIYTGSSDDSVHIYDVTGATVKKLS-W
Pruar_WDR23 II   (350) YRWMEYPAHAKTLKHPNDQSLATYRGHGVLRTLIRCYLSPAYSTGQKYIYTGSSDHCVYIYDLVTGAQVARLN-H
Sacof_WDR23 II   (341) YRWELFPSEAHNFKHPDDQSVATYRGHSVLRTLIRCYFSPVHSTGQRYIYTGSSDKSVHIYDVSGKTVKRLS-W
Triae_WDR23 II   (337) YRWMSFPSHARYKHPNDLSLATYRGHSVLRTLIRCYFSPMHSTGQRYIYTGSSDDSVHIYDVTGATVKKLS-W
Zeama_WDR23 II   (342) YRWMPFPSEAHNLKHPGDQSVATYRGHSVLRTLIRCYFSPVHSTGQRYIYTGSSDKSVHIYDVTGEAVKRLS-W Consensus        (376) YRWMDYP    ARDLKHP  DQSVATYKGHSVLRTLIRCYFSP YSTGQKYIYTGSHDSSVYIYDLVSGAQVAKL H
PF00400                                  XXXXXXXXXXXXXXXXXXXXXXXX   XXXXXXXXXXXXXXXXXXXXXXX  XXXXXXXXXX Predicted WD40                  Predicted WD40
                                          repeat PF00400:                 repeat PF00400:
                                                IV                              V
```

FIGURE 24 (continued)

```
                    451                                                                                     514
Aqufo_WDR23   (437) HSSTVRDCSWHPFYPTLVSSSWIGVLARCEFPGNGEK-IRLKRSRRYES-----------------------
Brana_WDR23   (444) HSSPVRDCNWHPHYPTLISSSWIGDLVKWEFPGSGEAPIMS-KKRVRRHFYY-----------------------
Arath_WDR23   (442) HSSPVRDCNWHPYYPTLISSSWIGDLVKWEFPGSGEAPIMS-KKRVRRHFYY-----------------------
Helan_WDR23   (436) HKSTVRDCSWHPYYPMLVSSSFIGDIAKWEFPGNGENPIPVNNSRPRRQYYD----------------------
Linus_WDR23   (439) HNSPVRDCSWHPHYPMLVSSSWIGDIVRWEFVGNGEAPMPMAKKRLRRRQYY-----------------------
Liter_WDR23   (426) HKATVRDCSWHPNYPMLVSSSFIGEIVKWEYRGNDEAPVQGNNQRLQR---------------------------
Lyces_WDR23   (436) HRSTIRDCSWHPTYPMLVSSSWIGDVVKWEFPGNGEAPLPPKRKQIRRRHFF-----------------------
Medtr_WDR23   (440) HKSPVRDCSWHPFHPMLVSSSWIGDVVKWQSAGSSDMAASSVKKRVNKRHFYEDYL-------------------
Orysa_WDR23   (421) HQLAIRDCSWHPFDPMLVSSSWIGRVAKWSRSSCQQEETTDLD--------------------------------
Pinra_WDR23   (440) HKSPVRDCSWHPEYPMIVSSSWIGDIVKWEFFGNGETEIPAMKKRIRRRHLY-----------------------
Poptr_WDR23   (437) HKSPVRDCSWHPYYPMLVSSSWIGDVVKWEFPGNGEAPVPSTKKRIRRRQFD-----------------------
Triae_WDR23   (418) HHLAVRDCSWHPSDPMLVSSSWIGQVARWSRTRSKQ-DTCELD--------------------------------
Vitis_WDR23   (438) HKSVVRDCNWHPNYPILVSSSWIGDIVKWEFPGNGEPPLIKKRIRRKYL--------------------------
Zeama_WDR23   (420) HQMAIRDCSWHPFEPTLVSSSWIGRVVKWTSARDEG--ASDVD--------------------------------
Glyma_WDR23   (420) HEAPVRDCSWHPYYPMMISSAWIGDVVRWEFPGSDEAPASPNKREGRIRRRNLLYL-------------------
Horvu_WDR23 II (412) HGSIIRDCTWHPYYRPTLVSSSWIGYLARWEASGDNEDPSVLTCDEQRNSPYHETYGLL----------------
Pruar_WDR23   (424) HEGPVRDCSWHPLYPMLVSSSWIGTIARWEFPGDDQVPTLERPRAR--RKERLL---------------------
Sacof_WDR23 II (415) HGSIIRDCTWHPYYPTLVSSSWIGYVARWEASGDDDDPSVLVHDEKRATRYFRRYANPFTDPFM
Triae_WDR23 II (411) HGSIIRDCTWHPYYRPTLVSSSWIGYLARWEASGNNEDPSVLTCDEQRTSPYDQTYGLSFAL-------------
Zeama_WDR23 II (416) HGSIIRDCTWHPYYPTLVSSSWIGFVARWEASGDDDDHSVLVADEMRGSPYYRRYGDPLVM--------------

Consensus     (451) H S VRDCSWHPYYPMLVSSSWIGDVVKWEF      G  E PS    KRR    Y
PF00400             XXXXXXXXXXXXXXXXXXXXXXXXXXXXXXXX Predicted WD40       End of
repeat PF00400:      Conserved Domain
V (cont'd)
```

FIGURE 24 (continued)

SEQ ID NO: 215 Arabidopsis thaliana Arath_WDR23-like nucleic acid sequence
ATGTTTTTTGGACCAAGTGAGTTTGATGCTGATGAAATGGGTTATGCAATGAGTAGACTTGAGATA
GAATCCGATCTATGTGATACTGGAAAAGACGTTTGTGGAGTTGGTAGTAGTAGTGGTAGTCACAGA
TCAAGTGAACATTTGGCTGATCTAGACCATGAAATCAGCCAGGTTACTAAATTGAAATCTAGTCCT
CATCAACGGTATAGCCGTGAAGTCCCTGGGAGACATCAGTTACCTGTGTCTACTGTGAGGATGTTG
GCAGGTCGAGAAAGTAATTTCTCTGGAAGAGGAAGGTTTTCAGCCGCTGATTGTTGCCATATGCTA
AGCAGATATTTGCCTACAAAAGGTCCTTGGCTTGTAGATCAAATGGACAGCCGAGCATATGTCTCT
CAGTTTTCAACTGATGGTTCTCTCTTTATTGCGGGGTTTCAGGGTAGCCGTATTCGGATTTACAAT
GTAGAGAAGGGTTGGAAAGTTCAAAAGGATATTCTTGCAAAAAGCTTGCGTTGGACTGTTACTGAT
ACTTCTCTATCCCCTGATCAGCGAAATCTGGTTTACGCAAGCATGTCACCTATTGTTCACATTGTT
GATGTTGGATCCGGTTCAACCGAGTCTCATGCAAATGTTACGGAGATCCATGATGGCTTAGACTTC
TCTTCTGATGAAGATGGAGGGTACTCTTTTGGAATATTCTCTGTGAAATTTTCAACAGATGGCCGA
GAAGTTGTTGCTGGGAGCAGTGATGATTCCATTTATGTTTATGACCTTGAAGCAAATCGAGTTTCA
CTCCGGACTGTTGCACACACGTCTGATGTAAATACTGTGTGCTTTGCTGATGAAAGTGGGAACCTG
ATTTTATCTGGAAGTGATGATAATCTCTGCAAAGTGTGGGATAGGCGTTGTTTCATTGGGAGAGAT
AAGCCAGCTGGTGTTTTAGTGGGACACCTCGAAGGTGTTACCTTTATCGATAGCCGTGGAGATGGT
CGCTATTTCATATCAAATGGTAAAGACCAAACTATCAAATTGTGGGATATCAGAAAAATGTCCTCA
AGCGCACCTGCAAGGCATGAGGTGCTAAGAAACTATGAATGGGACTACAGATGGATGGATTATCCT
ACTGAAGCAAGAGATCTAAAGCACCCACTCGATCAGTCAGTGTCGACATATAAAGGTCACTCAGTT
TTGCGTACTCTCATCCGTTGTTACTTCTCTCCAGCGCATAGTACTGGCCAAAAGTACATCTACACA
GGATCGAACGACAGTTCCGTCTACATATACGACTTGGTAAGTGGAGATAAAGTGGCAGTGCTAAAG
CACCATAGCTCACCTGTAAGAGACTGTAATTGGCACCCATATTACCCAACGCTTATAAGCTCTTCG
TGGGACGGAGATCTTGTGAAGTGGGAATTTCCGGGGAGCGGTGAGGCGCCGATTATGAGTAAGAAG
AGGGTTCGAAGGAGACATTTCTACTACTGA

SEQ ID NO: 216 Arabidopsis thaliana Arath_WDR23-like translated polypeptide sequence
MFFGPSEFDADEMGYAMSRLEIESDLCDTGKDVCGVGSSSGSHRSSEHLADLDHEISQVTKLKSSP
HQRYSREVPGRHQLPVSTVRMLAGRESNFSGRGRFSAADCCHMLSRYLPTKGPWLVDQMDSRAYVS
QFSTDGSLFIAGFQGSRIRIYNVEKGWKVQKDILAKSLRWTVTDTSLSPDQRNLVYASMSPIVHIV
DVGSGSTESHANVTEIHDGLDFSSDEDGGYSFGIFSVKFSTDGREVVAGSSDDSIYVYDLEANRVS
LRTVAHTSDVNTVCFADESGNLILSGSDDNLCKVWDRRCFIGRDKPAGVLVGHLEGVTFIDSRGDG
RYFISNGKDQTIKLWDIRKMSSSAPARHEVLRNYEWDYRWMDYPTEARDLKHPLDQSVSTYKGHSV
LRTLIRCYFSPAHSTGQKYIYTGSNDSSVYIYDLVSGDKVAVLKHHSSPVRDCNWHPYYPTLISSS
WDGDLVKWEFPGSGEAPIMSKKRVRRRHFYY

SEQ ID NO: 217 Aquilegia formosa x Aquilegia pubescens Aqufo_WDR23-like nucleic acid sequence
ATGTTTGTTACAGCCAGTGGGGTTGACATTGATGAAATGGGGTACGCCATGAGTAGGCTAGAGATA
GAATCCGAGTTGTTCGATGGCGGTAATACCGTCCATGAAGCCAGTAGCAGTACTAGGCCCGGCAAA
CTGTTTCCTAAAGTAGATGACGAGATTTCCCAGCTTACAAACCTCAGATCAGGGCCTAATGATCGA
CTGCATCAACTTGTGCCCGGAAAGCAGCAATTACCTGTTTCCCCGGTGAGGATGTTGGCAGGTCGA
GAAAGTAATTATTCAGGAAAGGGAAGGTTCTCGTCAGCGGATCGTTGTCACATGCTTAGCAGGTAT
TTGCCTGTAAATGGTCCTTGGCTTGTGGACCAGACGACCAGTCGGGCCTATGTTTCTCAATTTTCA
GCTGATGGTTCTCTATTTGTTGCCGGGTTTCAGGGAAGCGATATTAGAATATACAATGTGGATAGA
GGCTGGAAAGTTCAGAAGAACATTCTTGCCAAAAGTTTGCGTTGGACTGTTACTGACACATCCCTT
TCCCCTGATCAGCGCCATCTTGTTTATACCAGTATGTCACCCATAGTCCATATTGTTAATGTTGGG

FIGURE 26

```
TCTGCTACCACGGAATCCCTTGCAAATATAACAGAGGTCCATGAAGGATTGGACTTCTCTGCTGCT
GATGGAGGGTATTCTTTTGGAATATTCTCTGTGAAATTTTCAACCGATGGACGAGAACTTGTTGCT
GGAAGCAGTGATGATTCGATATATGTTTATGATCTTGAAGCAAACAAGCTTTCCCTTCGAATTGCG
GCACACATGGCTGATGTTAATACTGTAACCTTTGCTGATGAAAGTGGTAATCTGATATATTCAGGA
AGTGATGATAATCTCTGCAAGGTGTGGGACAGGCGTTGTCTCAGAGCAAAGGGAAAACCAGCAGGG
GTTTTGACGGGCATTTAGAAGGCATTACGTTTATTGATAGCCGTGGAGATGGTCGATATTTTATA
TCAAATGGAAAAGACCAGGCCATTAAACTTTGGGACATCAGGAAAATGTCGGCTAATGCTAGTTGC
ATTGCAAAATCTAGAAATTACGAATGGGACTACAGATGGATGGAATACCCAACTGAGGCGAGAAAG
TTAAAACATCCTTGTGATCAGTCTTTGGCTACATACAAAGGGCACTCTGTCTTGCGTACTCTCATC
CGTTGTTACTTTTCACCGGCTTACAGCACTGGCCAGAAGTACATCTACACCGGATCAAATGATGGT
TGCGTTTATATATATGATTTGGTAAGTGGAGCCCAAGTTGCTCGACTAGATCATCATTCATCCACT
GTGAGGGATTGTAGTTGGCACCCTTTCTACCCAACGCTTGTCAGCAGTTCATGGGATGGGGTCCTT
GCCAGATGTGAATTTCCTGGCAATGGAGAAAAAATTCGGCTGAAGAGAAGCAGGAGGAGATATGAA
TCTTGA

SEQ ID NO: 218 Aquilegia formosa x Aquilegia pubescens
Aqufo_WDR23-like translated polypeptide sequence
MFVTASGVDIDEMGYAMSRLEIESELFDGGNTVHEASSSTRPGKLFPKVDDEISQLTNLRSGPNDR
LHQLVPGKQQLPVSPVRMLAGRESNYSGKGRFSSADRCHMLSRYLPVNGPWLVDQTTSRAYVSQFS
ADGSLFVAGFQGSDIRIYNVDRGWKVQKNILAKSLRWTVTDTSLSPDQRHLVYTSMSPIVHIVNVG
SATTESLANITEVHEGLDFSAADGGYSFGIFSVKFSTDGRELVAGSSDDSIYVYDLEANKLSLRIA
AHMADVNTVTFADESGNLIYSGSDDNLCKVWDRRCLRAKGKPAGVLTGHLEGITFIDSRGDGRYFI
SNGKDQAIKLWDIRKMSANASCIAKSRNYEWDYRWMEYPTEARKLKHPCDQSLATYKGHSVLRTLI
RCYFSPAYSTGQKYIYTGSNDGCVYIYDLVSGAQVARLDHHSSTVRDCSWHPFYPTLVSSSWDGVL
ARCEFPGNGEKIRLKRSRRRYES SEQ ID NO: 219 Brassica napus Brana_WDR23-like nucleic acid
    sequence
ATGTTTTCTGGACCAAGTGATTCTGATACTGATGAAATGGGTTATGCAATGAGTAGACTCGAGATT
GAATCCGATCTATGCGACGCTGGAAAGGGCTATTACGGTGTTGGTAGCAGCAGTGGTAGTAGTCAC
AGATCGAGTGAGCGTTTGGGTGATTTAGACAATGAGATCAGCCAAGTCACTAAGCTGAAGTCTTGT
CCTCATGAACGGTTTAGCCGTCAAGTACCCGGGAGGCATCAGTTGCCTGTTTCCACTGTGAAGATG
TTGGCTGGTCGTGAGAGTAACTTCTCTGGAAGAGGAGGAAGGTTTCTTCAGCTGATCGTTGTCAT
ATCTTGAGTAGATATTTGCCTGTTAAGGGTCCTTGGCTTGTGGATCAGATGGACAGCCGAGCTTAT
GTCTCTCAGTTTTCAACTGATGGGTCTCTCTTCATTGCTGGGTTTCAGGGAAGCCATATTCGGATT
TACAATGTAGAGAAAGGTTGGAAAGTTCAAAAGGATATTCTTGCAAAGAGCTTGCGTTGGACTGTT
ACTGATACTTCTCTGTCCCCTGATCAGCGAAACCTGGTTTATGCAAGCATGTCACCTATTGTTCAC
ATAGTCGATGTTGGATCTGGTACAACCGAGTCTCACGCAAATGTCACGGAGATCCATGATGGATTA
GACTTCTCTTCTGAAGAAGATGGAGGCTACTCTTTTGGGATATTCTCTGTGAAATTTTCAACAGAT
GGACGAGAACTCGTTGCTGGTAGCAGTGATGATTCCATTTACGTTTATGATCTCGAAGCAAACCGA
GTCTCACTCCGGACTGTTGCACACACGTCTGATGTGAACACTGTGTGTTTCGCCGATGAAAGTGGA
CACCTGATTCTCTCTGGAGGTGATGATAATCTCTGCAAGGTGTGGGATAGGCGTTGTTTCATTGGG
AGAGATAAGCCAGCTGGTGTTCTGGTGGGACACCTAGAAGGTGTTACATTTATCGATAGCCGCGGA
GATGGTCGCTATTTCATATCAAATGGAAAGACCAAACCATCAAGCTATGGGATATTAGAAAAATG
TCCTCAACTGTACCTGCAAGGAATGAGGTGCACAGAAACTATGAATGGGATTACAGATGGATGGAT
TACCCTTCGGAGGCAAGAGATCTAAAGCACCCTTATGATCAGTCTGTGTCTACATATAAGGGTCAC
TCAGTGTTGCGTACTCTCATCCGTTGCTACTTCTCTCCAGCTCATAGTACTGGTCAAAAGTACATA
TACACAGGATCCAACGACAGTTCTGTCTACATATATGACTTGGAAAGTGGAGATAAAGCGGCGGTG
TTAAAGCACCATAGCTCACCTGTGAGAGACTGTAACTGGCATCCGCATTATCCGACGCTTATAAGC
TCGTCGTGGGACGGAGATCTTGTGAAATGGGAGTTTCCTGGGAGCGGTGAGGCGCCGATCATGAGC
AAGAAGAGGGTCCGAAGGAGACATTTCTACTACTGA
```

FIGURE 26 (continued)

SEQ ID NO: 220 Brassica napus Brana_WDR23-like translated polypeptide sequence
MFSGPSDSDTDEMGYAMSRLEIESDLCDAGKGYYGVGSSSGSSHRSSERLGDLDNEISQVTKLKSC
PHERFSRQVPGRHQLPVSTVKMLAGRESNFSGRGGRFSSADRCHILSRYLPVKGPWLVDQMDSRAY
VSQFSTDGSLFIAGFQGSHIRIYNVEKGWKVQKDILAKSLRWTVTDTSLSPDQRNLVYASMSPIVH
IVDVGSGTTESHANVTEIHDGLDFSSEEDGGYSFGIFSVKFSTDGRELVAGSSDDSIYVYDLEANR
VSLRTVAHTSDVNTVCFADESGHLILSGGDDNLCKVWDRRCFIGRDKPAGVLVGHLEGVTFIDSRG
DGRYFISNGKDQTIKLWDIRKMSSTVPARNEVHRNYEWDYRWMDYPSEARDLKHPYDQSVSTYKGH
SVLRTLIRCYFSPAHSTGQKYIYTGSNDSSVYIYDLESGDKAAVLKHHSSPVRDCNWHPHYPTLIS
SSWDGDLVKWEFPGSGEAPIMSKKRVRRRHFYY

SEQ ID NO: 221 Glycine max Glyma_WDR23-like nucleic acid sequence
ATGAGTTGGTTGAATAAAAATAAAAGTACTTGTAGTGATGGTAGTGCCAATAATGAATCTTCTTCA
AGTGGAATAGTTGGAGAAAGGGATAATCATCTTGATCATGAAATTGCACAGCTCACAAAACTTAGG
TCAAGTCCTCATGAGCTTTTGGGTCGTGTTGTTCCTGGTAAGATGAGGTTACCTGCATCTACTGTG
AGAATGCTGGTTGGTAGAGAAGGTAATTATTCTGGAAGAGGGAGATTTTCATCAGCAGATGGGTGT
CATGTGTTAAGCCGCTATTTGCCTACCAAAGGTCCTTGGATTGTGGATCGGATGAAAAGTCGTGCC
TATGTTTCACAGTTTTCTGCTGATGGTTCTCTTTTAATTGCTGGATTCCAGGGAAGCCACATCAGG
ATCTATGATGTTGACCAGGGCTGGAAAGTTAAAAAGGACATTTCTGCTAGAAAGTTACGGTGGACA
GTTACTGATACATCTCTCGCCAGATCAACTCTATCTTGTTTATGCCAGTATGTCACCAATTATC
CATATTGTTACCGTGGGATCTGGCACAACAGAATCAATAGCAAATGTTACAGAAATTCACTATGGA
TTAAATTTCTCTTCTGATAATGGTGATGATGAATTTGGAATTTTCTCTGTCAAATTTTCAACGGAT
GGGCGAGAGCTTGTGGCTGGAACTAGTGATTGCTCGATATGTGTATATGATCTTGGAGCAGATAAG
CTGAGCCTTAGAATTCCTGCTCACCAGTCTGATGTTAACACTGTCTGCTTTGCTGATGAATCTGGC
CATCTAATATTTTCCGGTAGTGATGATAGTTTTATCAAGGTGTGGGATAGGCGTTGTTTTGTCGCC
AAAGGACAACCAGCTGGTATCTTAATGGGACATTTAGAAGGCATTACATTCATTGATAGCCGTGGG
GATGGTCGATATTTAATTTCTAATGGAAAAGATCAAACTACCAAATTATGGGATATAAGGAAGATG
TCTTCTAATGCAATAAATCTTGGCCTTGGAGATGATGAGTGGGACTATCGATGGATGGACTACCCT
GAATATGCAAGAAATTTAAAGCATCCTCATGATCAGTCATTAGCAACATATAAAGGTCACTCAGTG
TTGCGTACTTTAGTGCGCTGTTATTTCTCTCCTTCGTATAGCACTGGTCAAAAGTACATTTACACA
GGGTCTAGTGATTCATCTGTTTACATATATGACCTGGTAAGTGGTGCACAAGTTGCAAAACTTGAT
CATCATGAGGCACCTGTAAGGGATTGTAGTTGGCACCCTATTATCCAATGATGATCTCTTCGGCT
TGGGATGGTGATGTTGTCAGGTGGGAATTTCCTGGGAGTGATGAAGCCCCTGCTTCTCCAAATAAA
AGAGAAGGTCGAATTCGTAGGAGAAATTTGCTTTATCTATAG

SEQ ID NO: 222 Glycine max Glyma_WDR23-like translated polypeptide sequence
MSWLNKNKSTCSDGSANNESSSSGIVGERDNHLDHEIAQLTKLRSSPHELLGRVVPGKMRLPASTV
RMLVGREGNYSGRGRFSSADGCHVLSRYLPTKGPWIVDRMKSRAYVSQFSADGSLLIAGFQGSHIR
IYDVDQGWKVKKDISARKLRWTVTDTSLSPDQLYLVYASMSPIIHIVTVGSGTTESIANVTEIHYG
LNFSSDNGDDEFGIFSVKFSTDGRELVAGTSDCSICVYDLGADKLSLRIPAHQSDVNTVCFADESG
HLIFSGSDDSFIKVWDRRCFVAKGQPAGILMGHLEGITFIDSRGDGRYLISNGKDQTTKLWDIRKM
SSNAINLGLGDDEWDYRWMDYPEYARNLKHPHDQSLATYKGHSVLRTLVRCYFSPSYSTGQKYIYT
GSSDSSVYIYDLVSGAQVAKLDHHEAPVRDCSWHPYYPMMISSAWDGDVVRWEFPGSDEAPASPNK
REGRIRRRNLLYL

FIGURE 26 (continued)

SEQ ID NO: 223 Gossypium hirsutum Goshi_WDR23-like nucleic acid sequence
ATGTTTGTTACAGCCAGTGGGGTTGACATTGATGAAATGGGGTACGCCATGAGTAGGCTAGAGATA
GAATCCGAGTTGTTCGATGGCGGTAATACCGTCCATGAAGCCAGTAGCAGTACTAGGCCCGGCAAA
CTGTTTCCTAAAGTAGATGACGAGATTTCCCAGCTTACAAACCTCAGATCAGGGCCTAATGATCGA
CTGCATCAACTTGTGCCCGGAAAGCAGCAATTACCTGTTTCCCCGGTGAGGATGTTGGCAGGTCGA
GAAAGTAATTATTCAGGAAAGGGAAGGTTCTCGTCAGCGGATCGTTGTCACATGCTTAGCAGGTAT
TTGCCTGTAAATGGTCCTTGGCTTGTGGACCAGACGACCAGTCGGGCCTATGTTTCTCAATTTTCA
GCTGATGGTTCTCTATTTGTTGCCGGGTTTCAGGGAAGCAATATTAGGATATACAATGTGGATAGA
GGTTGGAAAGTTCAAAAGAACATTCTTGCTAAAAGTTTGCGTTGGACAGTTACCGACACATCCCTT
CTCCGGATCAGCGGTACCTTGTTTATACCAGCATGTCGCCTGTAGTTCACATTGTTAATGTTGGG
TCTTCTACCACGGAATCCTTTGCAAATGTCACGGAGATCCACGAAGGATTGGACTTTTCTTCTAAT
GATCGAAGGTATTCTTTTGGAATATTCTCCGTGAAATTTTCAACTGATGGACGAGAACTTGTGGCT
GGAAGCAGTGATGACTCGATATATGTTTATGATCTGGAAGCAAACAAGCTTTCCCTTCGAATTATG
GCACACACGGCTGATGTTAACACGGCAACCTTTGCCGATGAAAGCGGCAATTTGATATATTCTGGG
AGTGATGATTATCTCTGCATGGTGTGGGATAGGCGTTGCTTTGGAGCAAAAGATAAGCCGGCAGGA
GTTTTGGTGGGACACCTGGAAGGTATTACATTCCTCGACAGTCGTGGGGATGGTCGTTACTTCATA
TCAAACGGTAAAGATCAGACTATCAAGCTTTGGGATATCCGGAAAATGTCCTCCGATACCTCTTGC
AATTTAGGGTATCGGAATTTCGAATGGGATTACAGATGGATGGACTACCCTCCACAGGCTAGAGAT
TTGAAACACCCAAGTGACGGATCAGTGGCTACTTATAAAGGTCACTCAGTGTTGCGCACTCTTATT
CGCTGTTATTTTTCACCCGAATACTGCACGGGCCAAAAGTACATTTACACCGGATCTCACGATTCT
CGGGTTTATATTTATGATGTGGTCACCGGAGCCCAAGTTGCGGTACTGAAGCACCATACATCACCA
GTAAGAGACTGTAGTTGGCACCCGCATTACCCTGTGTTGGTCAGCTCCTCTTGGGACGGGGACGTG
GTTAAGTGGGAATTCCCTGGTAAAGGAGAAGCGCCGGTCCTTGCGAACGAGAGGAGAGTCAGGAGG
CAATATCACGATTGA

SEQ ID NO: 224 Gossypium hirsutum Goshi_WDR23-like translated polypeptide sequence
MFVTASGVDIDEMGYAMSRLEIESELFDGGNTVHEASSSTRPGKLFPKVDDEISQLTNLRSGPNDR
LHQLVPGKQQLPVSPVRMLAGRESNYSGKGRFSSADRCHMLSRYLPVNGPWLVDQTTSRAYVSQFS
ADGSLFVAGFQGSNIRIYNVDRGWKVQKNILAKSLRWTVTDTSLSPDQRYLVYTSMSPVVHIVNVG
SSTTESFANVTEIHEGLDFSSNDRRYSFGIFSVKFSTDGRELVAGSSDDSIYVYDLEANKLSLRIM
AHTADVNTATFADESGNLIYSGSDDYLCMVWDRRCFGAKDKPAGVLVGHLEGITFLDSRGDGRYFI
SNGKDQTIKLWDIRKMSSDTSCNLGYRNFEWDYRWMDYPPQARDLKHPSDGSVATYKGHSVLRTLI
RCYFSPEYCTGQKYIYTGSHDSRVYIYDVVTGAQVAVLKHHTSPVRDCSWHPHYPVLVSSSWDGDV
VKWEFPGKGEAPVLANERRVRRQYHD

SEQ ID NO: 225 Helianthus annuus Helan_WDR23-like nucleic acid sequence
ATGTACTCTAGGGGTTGGACCACACTTATAGGTGACATGGGATATGCCCTAAGTAGATTGGAAATC
GACCCAGATTATTCTGATAACGGATCTGTTGGAGACGATAATGACAGCCACCAGTCTTCATCACAA
AATGATGTGGATCCTGAAGTTGCTCAGTTAACAAAGCTGAAATCAGCACCCCATGATGGATTGAAA
CGCGTTCTTCCACGAAGGGGGGAATTTGATGTTTCGCCTGTGAAGATGTTAGCGGGTCGAGAAGGG
AATTATTCGGGTCGTGGGAAGTTTTCTTTAGCAGATCGTTGTCATATGCTAAACAAATATTTACCT
GTTAAAGGTCCTTCTATTGTTGACCAATTGACCACCCGGGCTTATGTCTCACAGTTTTCAAAAGAC
GGGTCCCTTTTTGTTGCTGCATTTCAGGGAAGTCAGATTAAAATTTATAATGCTGAAATGGGGTGG
AAACTTCACAAGAAAATTGTTGCTGAAAGCTTTAATTGGACGGTTACTGACACATCTATTTCACCA
GATAAACGTTTCCTGATTTATTCAACTTTGTCTCCTATAGTCAACATTGTAAATATTGGATCTGCT FIGURE 26 (continued)

```
GGAACAGAGTCTCATGCAAATGTCACGGACATACACGAAGGGCTAGAATTTGCAGCTGATGATGAA
GAAGGATATGCATTTGGAATTTTTTCTGTAAAATTTTCTAGTGATGGTAGAGAACTTGTAGCCGGA
AGTAGTGATGATTCAATTTATGTTTATGATATTGAAGCAAAAAGATTTTCCCTTCGAATTCAAGCG
CATACGTCAGATGTAAACAGTGTATGCTTTGCTGATGAAGCCAGCAATCTGATATATTCTGGGAGT
GATGATAATCTCTGTAAGGTTTGGGACAGACGTTCCATCAGATCAAAAGGAAAGCCAGTTGGAATC
CTCACGGGCATCTAGAAGGAATTACACATCTTGATAGCCGTAATGATGGTCGTTATTTCATTTCA
AATGGAAAAGATCAGACTATTAAGCTTTGGGATATCAGAAAAATGTCCTCTAATGCGGCTCGCGCT
CCTATATCCAGGAACTATGAATGGGACTACAGATGGATGGACTATCTACTTAGGGCACGAGATGTA
AAGCATCCATCTGACCAGTCCGTTGCTACATACAAAGGTCATTCAGTATTGCGTACACTCATACGC
TGCTATTTTTCACCAGAATATAGCACTGGCCAAAGGTATATTTATACTGGATCTCATGATTCTTGT
GTGTATGTTTATGATTTGGTTACTGGGGCCCGGGTTGCAAGACTTGTGCACCATAAGTCAACCGTG
CGGGACTGCAGCTGGCACCCTTACTATCCAATGCTCGTCAGTTCTTCGTTTGATGGAGATATCGCA
AAGTGGGAATTTCCTGGAAACGGAGAGAACCCGATTCCCGTGAATAACAGTAGGCCTCGACGACAA
TATTATGATTAA

SEQ ID NO 226: Helianthus annuus Helan_WDR23-like translated
polypeptide sequence
MYSRGWTTLIGDMGYALSRLEIDPDYSDNGSVGDDNDSHQSSSQNDVDPEVAQLTKLKSAPHDGLK
RVLPRRGEFDVSPVKMLAGREGNYSGRGKFSLADRCHMLNKYLPVKGPSIVDQLTTRAYVSQFSKD
GSLFVAAFQGSQIKIYNAEMGWKLHKKIVAESFNWTVTDTSISPDKRFLIYSTLSPIVNIVNIGSA
GTESHANVTDIHEGLEFAADDEEGYAFGIFSVKFSSDGRELVAGSSDDSIYVYDIEAKRFSLRIQA
HTSDVNSVCFADEASNLIYSGSDDNLCKVWDRRSIRSKGKPVGILTGHLEGITHLDSRNDGRYFIS
NGKDQTIKLWDIRKMSSNAARAPISRNYEWDYRWMDYLLRARDVKHPSDQSVATYKGHSVLRTLIR
CYFSPEYSTGQRYIYTGSHDSCVYVYDLVTGARVARLVHHKSTVRDCSWHPYYPMLVSSSFDGDIA
KWEFPGNGENPIPVNNSRPRRQYYD SEQ ID NO: 227 Hordeum vulgare Horvu_WDR23-like II nucleic acid
sequence
ATGGCAGCGGCAGGGAGGCTGCGGGACGGCGGCGGGCGCAGAAGGAGGTGGAGCGCGAGCTCGAG
CCGTTCACTATCGAGGAAGAGGTGTCCCACCTCACCCGGGCTTTGTCGGAGCCGTGCCCGGGCACC
CGCGCCGCCGTCCGTGGCGCCAGGCGGAAGAGGGGCGTCTCGGCTTTCGACATGCTGTCGTCGAGG
GAGTCCGGCCGGTCCGGTGGCGGCGGGTTCTGCTCGGCCGACCGCGCCTACGCCGCCGGGAGGCAC
CTGCCCGCGGTAGGGCCGTGGTGCGTCGAAGACATGGATAGCGAGGCCTATGTTTCGCAGTTCTCC
AGCGATGGCTCACTGCTCGTTGCTGGGTTTCGGGGAAGCCGCATCAGAGTTTACGATGTCGATAAA
GGGTGGAAGGTGCATAAGAACATAAGCTGCAGAAGTATGAGGTGGACGGTTTCAGACATTGCTCTC
TCCCCTGACCAGCGATACCTTGCTTATTCCAGTTTGTCGCCTATTGTTCACATTGTGAATGTGCAG
AATGCTGGAAGGGAATCATATGCTAATGTTACTGAAATTCACGAGGGTTTGGAATTCTGTGATGAT
GATGAATACTCTTTCGGGATATTCTCTGTGAAATTTTCGAAAGATGGTAGAGAAGTTGTTGTTGGG
AACAATGATTGTTCAATATATGTCTATGATCTTGGAGCAAATAAAGTATCAGACCGTATCCGTGCT
CATATGGGTGATGTCAACACGGTTACCTTTGCTGATGAAAGTGGCAATTTGTTGTACTCTGGAAGT
GATGATAATCTCTGTAAGGTCTGGGATAGGCGTTGCCTTGTAAGAGAGAAACCAGCAGGTGTTTTG
ACAGGTCATTTAGATGGGATTACATTTATTGATAGCCGTGGTGATGGGCGTTATCTAATCTCGAAC
TGCAAGGACCAGACTATCAAACTTTGGACGTCAGAAAGATGTCCGCCACCGTCAAAGGACGACAA
CCGAGATTATATGACTGGGACTACAGATGGATGTCGCTCCCATCACACGCTAGATATTATAAGCAT
CCAGATGATCTGTCTCTGGCAACTTACAGGGGTCATTCAGTTCTGCGGACACTTATCCGCTGCTAC
TTCTCTCCAATGCACAGCACGGGCCAGAGGTACATATACACTGGATCAAGTGATGATTCAGTGCAT
ATTTACGATGTGGTAACCGGGGCGACCGTCAAGAAGCTCTCGTGGCACGGTTCGATCATCAGAGAC
TGCACCTGGCATCCTTACCGTCCAACACTTGTCAGCTCTTCCTGGGACGGCTATCTGGCCCGGTGG
GAGGCATCAGGCGACAACGAGGACCCCTCGGTGCTCACGTGCGACGAGCAGAGGAATAGCCCTTAC
CACGAGACATACGGGCTGTTGTAA
```

SEQ ID NO: 228 Hordeum vulgare Horvu_WDR23-like II translated polypeptide sequence
MAAAGRLRGRRRAQKEVERELEPFTIEEEVSHLTRALSEPCPGTRAAVRGARRKRGVSAFDMLSSR
ESGRSGGGGFCSADRAYAAGRHLPAVGPWCVEDMDSEAYVSQFSSDGSLLVAGFRGSRIRVYDVDK
GWKVHKNISCRSMRWTVSDIALSPDQRYLAYSSLSPIVHIVNVQNAGRESYANVTEIHEGLEFCDD
DEYSFGIFSVKFSKDGREVVVGNNDCSIYVYDLGANKVSDRIRAHMGDVNTVTFADESGNLLYSGS
DDNLCKVWDRRCLVREKPAGVLTGHLDGITFIDSRGDGRYLISNCKDQTIKLWDVRKMSATVKGRQ
PRLYDWDYRWMSLPSHARYYKHPDDLSLATYRGHSVLRTLIRCYFSPMHSTGQRYIYTGSSDDSVH
IYDVVTGATVKKLSWHGSIIRDCTWHPYRPTLVSSSWDGYLARWEASGDNEDPSVLTCDEQRNSPY
HETYGLL

SEQ ID NO: 229 Linum usitatissum Linus_WRD23-like nucleic acid sequence
ATGTTCTTCGTAGCTTCAACTGACGGGATGGGTTATGCCATGAGTAGATTGGAGATAGAATCTCAG
CTGTGTGACGAGGAAGAGACTGTCAATGAAGTTGGTGGTGGAAGCCAACAGCACAAGTCTCTTAAC
AAATCGGTAGAGAAATTGGACCATGAAGTTGCCCAGGACACTAACCTAAAATCTCAGCCCCATAGA
CGGCTCGAGAAGGAGATACCTGGGAAGAGACAGTTCCCAGTCTCTCCTGTAAAGATGTTGGCCGGT
CGAGAAGGTAATTTTTCCGGAAGGGGGAGGTTCTCGCGAGCTGATCGGTGTCATATGCTCAGCAGA
TATTTGCCTGCTGATGGCCCATGGCTTGTCGATCGAATGAATAGCCGAGCTTATGTCTCGCAGTTT
TCTTCTGATGGTACCTTGTTTGTTGCTGGCTTTCAGGGAAGCCATATTAAAGTATACAATGTCGAG
AAAGGGTGGAAAGTTCAGAAGGATATTATTGCCAGAAGTTTGCGTTGGACAGTTACGGATACCTCT
CTGTCTCCGGATCAACGGTTTCTTGTCTATGCCAGTATGTGCCCTATTGTGCACATTGTTAATATC
GCATCATCAACAACGGAATCAGTTGCAAATGTAACGGAGATTCACGATGGTTTAGACTTTTCTGAT
GAAGACGATGGGGGCTATGCTTTCGGGATCTTCTCAGTAAAATTTTCTACTGATGGTCGTGAACTA
GTTGCTGGAAGTAGTGATGATGCTATATGTGTCTATGATCTCGAAACTAATAAGCTCTCTCTCAGA
ATCCTAGCACACACATCTGATGTGAACACCGTCTGTTTTGCTGACGAGAGTGGGCATCTGATATAC
TCCGGGAGTGATGATAATCTCTGCAAGGTGTGGGATAGACGTTGCTTCATAGCAAAAGGGAAGCCT
GCAGGAGTCCTAACGGGACATATCGAAGGAATTACAGATATAGACAGCCGTGGAGATGGCCGATAT
TTAATATCAAATGGAAAAGATCAGACAATCAAACTTTGGGATATCAGGAAAATGGCCCCCAATGCT
ACAAGCTCTTTAGGGATCAGGAATTATGAATGGGATTACAGATGGATGGACTACCCACCACCAGCT
AGAGACTTGAAGCATCCATGCGATCTGTCCGTGGCTACTTATAAAGGTCACTCGGTTCTCCGAACG
CTTATTCGCTGCTATTTCTCACCAACCTATAGCACCGGCCAGAAATACATTTACACCGGATCTCAC
GACTCTTCTGTTTATATTTATGATGTGGCGACTGGGGAGGTAGCTGGAGTGCTGAAACACCATAAC
TCGCCGGTAAGAGATTGCAGTTGGCACCCGCACTATCCTATGCTGGTGAGCTCTTCATGGGATGGG
GATATAGTGAGGTGGGAGTTCGTCGGCAATGGAGAAGCTCCGATGCCTATGGCCAAGAAACGACTA
CGCAGAAGGCAATACTACGATGTCTGA

SEQ ID NO: 230 Linum usitatissum Linus_WRD23-like translated polypeptide sequence
MFFVASTDGMGYAMSRLEIESQLCDEEETVNEVGGGSQQHKSLNKSVEKLDHEVAQDTNLKSQPHR
RLEKEIPGKRQFPVSPVKMLAGREGNFSGRGRFSRADRCHMLSRYLPADGPWLVDRMNSRAYVSQF
SSDGTLFVAGFQGSHIKVYNVEKGWKVQKDIIARSLRWTVTDTSLSPDQRFLVYASMCPIVHIVNI
ASSTTESVANVTEIHDGLDFSDEDDGGYAFGIFSVKFSTDGRELVAGSSDDAICVYDLETNKLSLR
ILAHTSDVNTVCFADESGHLIYSGSDDNLCKVWDRRCFIAKGKPAGVLTGHIEGITDIDSRGDGRY
LISNGKDQTIKLWDIRKMAPNATSSLGIRNYEWDYRWMDYPPPARDLKHPCDLSVATYKGHSVLRT
LIRCYFSPTYSTGQKYIYTGSHDSSVYIYDVATGEVAGVLKHHNSPVRDCSWHPHYPMLVSSSWDG
DIVRWEFVGNGEAPMPMAKKRLRRRQYY

FIGURE 26 (continued)

SEQ ID NO: 231 Lithospermum erythrorhizon Liter_WDR23-like (or LEC14B) nucleic acid sequence
ATGGGGTATGCTATGAGTAGATTTGAAACTGATGTATCTGTAATCTTTAGTTCAAGTTCTGATTCT
GAGACTTCTCATGATTCTCTTATCAATAAGCCAGTGAAAAATTTGGATCATGAAATTGCTCAGCTT
ACTAGGCTTAGATCAGCACCCCACGAGAATCTAAGTAGAGACCTACTAGTTAAGAGGGTATTGCCG
CTTTCGACAATGAAAATGCTGGCTGGCAGAGAAGCTAATGTTTCAGGAAGAGGGAGGTTTTCATCT
GCAGATTGTTGTCATGTAGTCAGTCGACATTTGCCTGTTAACGATCCTTGTGTTGTCGATCAAATG
ACATCTAGAGTTTATTTGTCACAGTTTTCGACTGATGGTTCTCTTTTCATTGCTGGCTTTCAGGGA
TGCCACATCAGAATATACAATGTAGATAAAGGGTGGAAAGTTCAAAACGACATTATAGCAAAATGT
GTGAGATGGACAATTACTGATGCATCTCTTTCTCCAGATCAAAAGTTCCTTGCCTATGCTAGCTTG
ACACCAATTGCACATATTGTAAAATTTGGTTCTGCTGCTACGGAATCTCATGCAAATGTTACGGAT
ATACATGATGGATTGGATTTTTCATCTAACGATGATGGGGGATACTCTTTTGGGGTATTTTCCATC
AAGTTTTCAACCGATGGACGGGAAATTGTAGCTGGTACCAGTGATGAATCAATTTGTGTTTATGAT
CTAGAAGCAGATAGACTTTCCCTTAGAATTTCAGCCCACGAGTCAGATGTTAACTCTGTATGCTTT
GCTGATGAAAGCGGCCATCTTATTTATTCTGGAAGTGATGACAATCTCTGCAAGGTTTGGGACAGA
CGTTGCTTCAATGCCAAAGGAAAACCAGCAGGCATCTTGATGGGACACCTCGAAGGAATTACATTT
ATTGATAGCCGAGGAGATGGGCGATATTTTATTTCAAATGGTAAAGATCAGACAATCAAACTCTGG
GATATCCGCAAAATGTCCTCGAATGCTGGCGGCACAATTCAAAGCAGAAATAGTGAATGGGACTAC
AGATGGATGGAATATCCACAAGAGGCAAGAGATTTGAAGCATCCATCTGATCTATCGGGTGCTACT
TACAAAGGCCACTCCGTCTTGTGTACTCTTATTCGCTGCTACTTCTCCCCAGACTATAGTACTGGC
CAGAAATACATCTACACTGGATCTCATGATGCAAATGTTTATATCTACGACTTGGTAACTGGAGAT
CAAGTTTCTACACTTCAGTACCATAAGGCAACTGTAAGGGATTGTAGTTGGCACCCAAACTATCCT
ATGCTTGTTAGCTCATCGTTTGACGGAGAAATTGTCAAATGGGAATATCGTGGAAACGATGAAGCT
CCCGTCCAAGGAAACAATCAGCGGCTTCAAAGATGA

SEQ ID NO: 232 Lithospermum erythrorhizon Liter_WDR23-like (or LEC14B) translated polypeptide sequence
MGYAMSRFETDVSVIFSSSSDSETSHDSLINKPVKNLDHEIAQLTRLRSAPHENLSRDLLVKRVLP
LSTMKMLAGREANVSGRGRFSSADCCHVVSRHLPVNDPCVVDQMTSRVYLSQFSTDGSLFIAGFQG
CHIRIYNVDKGWKVQNDIIAKCVRWTITDASLSPDQKFLAYASLTPIAHIVKFGSAATESHANVTD
IHDGLDFSSNDDGGYSFGVFSIKFSTDGREIVAGTSDESICVYDLEADRLSLRISAHESDVNSVCF
ADESGHLIYSGSDDNLCKVWDRRCFNAKGKPAGILMGHLEGITFIDSRGDGRYFISNGKDQTIKLW
DIRKMSSNAGGTIQSRNSEWDYRWMEYPQEARDLKHPSDLSGATYKGHSVLCTLIRCYFSPDYSTG
QKYIYTGSHDANVYIYDLVTGDQVSTLQYHKATVRDCSWHPNYPMLVSSSFDGEIVKWEYRGNDEA
PVQGNNQRLQR

SEQ ID NO: 233 Lycopersicon esculentum Lyces_WDR23-like nucleic acid sequence
ATGTATTTTGATTTCTTACACCCAGAGTCCATTGAAGACATGGGGTATTCTCTAAGTAAGTTAGAA
GTAGACACCGGACTCTTTGATGGTTCAAGTTCCAATCATGGGGTTGCTAGCAGTGTTCATCATGAA
AGACCAACAAATTATTTGGACCATGAAATTTCTCAACTTACTAAGCTTAGATCAGGACCCCATGAA
AATCTCAGTAGAATCCTACCAGGGAAAAAGGAAGTTCCTGTATCCGCATTCAAGATGTTAGCTGCT
CGAGAAGCCAATATTTCCGGTAGAGGAAGGTTTTCGAAGGCAGATTGTTGTCATGTTCTAAGTAAA
TATTTGCCAGTTAGTGGTCCTTGGATTGTGGACCAGATGGAAACCAGAGCTTATGTATCACAATTT
TCAGCAGATGGTTCCCTTTTTGTTGCTGCCTTTCAGGGAAGTCATATTAGAATATACAATGTGGAA
AGAGGGTGGAAAGTTCACAAGAATATTCATGCAAAAAGTTTGAGATGGACAGTTACTGATACATCT
CTTTCTCCGGATCAACGTCATTTGGTCTATGCTACTATGTCACCCATCGTACATATTGTAGATGTA
GGATCTGCTGCCTCTGAATCTGTAGCCAACATCACAGAAATTCATGATGGTTTGCTTTTGTCTACT FIGURE 26 (continued)

```
GACAATGATGATTTTGGAATTTTCTCTGTGAAATTTTCTACTGAAGGTCGGGAAGTTGTTGCTGGA
AGTAGTGATGATGCGATCTATGTTTATGATCTTGAAGCAAACAAACTCTCTCTTCGAATATCCGCA
CACAATTCTGATGTCAATTCTGTATGTTTTGCTGACGAAAGTGGCCATCTCATTTATTCTGGAAGT
GATGACAATCTGTGTAAGGTCTGGGATAGACGTTGTTTTAGGGCCAAAGAAAAGCCAGCCGGAGTC
TTGATGGGACACCTAGAAGGCGTTACGTTCCTTGATAGTCGGGGGGATGGTCGTTATTTCATTTCT
AACAGTAAAGATCAGTCCATCAAGCTCTGGGATATCCGCAAAATGTCTTCTCATGCTGCTCGCAAT
ATCTGGTTCAGGAATTATGAGTGGGACTATAGATGGATGGACTACCCTGCTCAAGCTAGAGACGTG
AAGCACCCTTATGATCAGTCAATATCCACTTATAAGGGTCATTCTGTCTTGCGTACTCTAATTCGC
TGCTACTTCTCACCAGAATATAGCACTGGGCAGAGATACATTTACACAGGATCCCATGATGCCTGC
GTATACATCTATGATTTGGTAAGTGGAGAGCAAGTCGCGAAATTGCAGCACCACCGGTCGACCATT
AGAGATTGTAGCTGGCACCCTACTTATCCAATGCTTGTTAGCTCTTCTTGGGATGGAGATGTTGTC
AAATGGGAATTCCCTGGAAATGGTGAAGCACCACTCCCTCCAAAAAGGAAGCAGATCAGAAGAAGG
CATTTCTTTTAA

SEQ ID NO: 234 Lycopersicon esculentum Lyces_WDR23-like translated
polypeptide sequence
MYFDFLHPESIEDMGYSLSKLEVDTGLFDGSSSNHGVASSVHHERPTNYLDHEISQLTKLRSGPHE
NLSRILPGKKEVPVSAFKMLAAREANISGRGRFSKADCCHVLSKYLPVSGPWIVDQMETRAYVSQF
SADGSLFVAAFQGSHIRIYNVERGWKVHKNIHAKSLRWTVTDTSLSPDQRHLVYATMSPIVHIVDV
GSAASESVANITEIHDGLLLSTDNDDFGIFSVKFSTEGREVVAGSSDDAIYVYDLEANKLSLRISA
HNSDVNSVCFADESGHLIYSGSDDNLCKVWDRRCFRAKEKPAGVLMGHLEGVTFLDSRGDGRYFIS
NSKDQSIKLWDIRKMSSHAARNIWFRNYEWDYRWMDYPAQARDVKHPYDQSISTYKGHSVLRTLIR
CYFSPEYSTGQRYIYTGSHDACVYIYDLVSGEQVAKLQHHRSTIRDCSWHPTYPMLVSSSWDGDVV
KWEFPGNGEAPLPPKRKQIRRRHFF SEQ ID NO: 235 Medicago truncatula Medtr_WDR23-like nucleic acid
sequence
ATGTACGCTATATCCGGTGCACTTTACGTTGACCAAATGGGCTATGCTATGAGTAGATTAGACGTG
GACTCTAGTGATACTGAAGATGGAAATGCAATCCTTGAAGATTCTAGTACTGGAAAAGCTAAAAAG
GCATTTGAAAATTTAGACAATGAAATTGCTCAAATAACCAAGTTGAAATCAACACCTCATCAACTG
CTAGTACATGATGGATCTGGAAGGAAAGAGTTGCCTGTTTCCCCGGTGAAGATGCTGGCAGGCCGC
GAATCTAATTGTTCAGGACGGGGAAGGTTTTCTTCCGCTGATCGCTGTCATCTTTTGAGCAGGTAT
TTACCTGTAAATGGTCCTTGGCCTATCGACCAAATGCCTAGTCGAGCATACGTGTCTCAGTTTTCA
GCTGATGGTTCTCTTTTTGTTGCTGGGTTCCAGGGAAACCACATAAAAATATACAATGTGGAGAAA
GGTTGGAAAGTTCAAAAAACATTCTAACCAAGAGTTTGAGATGGACAATCACTGATACTTCTCTT
TCCCCTGATCAAAGTCATCTAGTTTATGCCAGCATGTCACCCATTGTACACATTGTGAATGTTGGA
TCTTCTGAGACAGAGTCACTAGCAAATGTGACGGAGATCCACGATGGGTTGGATTTTTCATCAAAC
GACGATGGAGGATACTCTTTTGGAATTTTCTCTTTGAAATTTTCAACAGATGGGAAGGAATTAGTT
GCAGGAACTAGTGGCGATTCTATATATGTATACGATCTTGAAACAAATAAGGTTTCACTTCGAATT
TTAGCACACACGGCTGATGTAAACACTGTATGTTTTGCTGATGAAACTGGCCATCTTATTTACTCT
GGAAGTGATGATAGTTTCTGCAAGGTCTGGGATCGGCGTTGCTTAAATGCTAAAGACAAGCCAGCA
GGGGTTTTGATGGGACACCTTGAGGGCATTACGTTTATTGATTCCCGTGGAGATGGACGCTATTTC
ATTTCAAACGGTAAAGATCAGACCATCAAACTTTGGGACATACGTAAAATGTCATCCAATGTTACC
AGTAACCGTGTCCGTGGATATAGGAGTTTTGAATGGGATTACAGGTGGATGGATTACCCGCCACAA
GCAAAAGACTTGAATCATCCTTGTGATCAGTCAGTGGCTACATATAGAGGCATTCAGTCTTACGC
ACTCTTGTCCGCTGCTTTTTTTCTCCAGCTTTTAGCACTGGCCAGAAGTACATCTATACTGGATCA
CACAACGCATGTGTTTATGTATATGATTTGGTGAGTGGAGCACAAGTTGCAACATTGAAGCACCAT
AAATCACCTGTAAGAGATTGTAGTTGGCATCCCTTCCACCCTATGCTTGTTAGCTCTTCTTGGGAT
GGAGATGTTGTAAAATGGCAATCTGCTGGAAGCTCTGATATGGCAGCCTCGTCGGTTAAGAAGAGG
GTAAACAAAAGACATTTTTATGAAGATTACCTATGA
```

FIGURE 26 (continued)

SEQ ID NO: 236 Medicago truncatula Medtr_WDR23-like translated polypeptide sequence
MYAISGALYVDQMGYAMSRLDVDSSDTEDGNAILEDSSTGKAKKAFENLDNEIAQITKLKSTPHQL
LVHDGSGRKELPVSPVKMLAGRESNCSGRGRFSSADRCHLLSRYLPVNGPWPIDQMPSRAYVSQFS
ADGSLFVAGFQGNHIKIYNVEKGWKVQKNILTKSLRWTITDTSLSPDQSHLVYASMSPIVHIVNVG
SSETESLANVTEIHDGLDFSSNDDGGYSFGIFSLKFSTDGKELVAGTSGDSIYVYDLETNKVSLRI
LAHTADVNTVCFADETGHLIYSGSDDSFCKVWDRRCLNAKDKPAGVLMGHLEGITFIDSRGDGRYF
ISNGKDQTIKLWDIRKMSSNVTSNRVRGYRSFEWDYRWMDYPPQAKDLNHPCDQSVATYRGHSVLR
TLVRCFFSPAFSTGQKYIYTGSHNACVYVYDLVSGAQVATLKHHKSPVRDCSWHPFHPMLVSSSWD
GDVVKWQSAGSSDMAASSVKKRVNKRHFYEDYL SEQ ID NO: 237 Oryza sativa Orysa_WDR23-like nucleic acid sequence
ATGGGTTATGGCATGAGTAGGATGGAGGAGGAATACAGCGAGCATGAAGATCAGAATAATGGTGGA
TCTAATTCACAAGTGAATAATGAGTTCTTAAACACACATAATGATATTTTCCATATGACTCAAATA
AGATCAGGACCTAGTGAAAGTCTTCGCAAGTCTATTGGTACAAGCAAAGATGTGATATCGACAACC
AGGTTATTGTCTGGAAGGGAAATTAATTCTTCAGGAAATGGGAAGTTCTCTTCAGTTGATCGTGCG
TTTCTTCTTGGTCGTTATCTTCCAGTTGATGGCCCTGAAATAGTGGACAGGATGGATTCCCGAGCT
TATGTTTCACAGTTTTCTGCTGATGGATCTCTTTTTGTTGCTGGTTTTCAGGGAAGCCACATAAGA
ATATATGATGTTGATAAAGGTTGGAAAGTACATAGGGACATTCATGCTAGAAGTTTGAGATGGACC
ATTAGTGACGCATCACTTTCCCCTGATCAACAGTTTCTTGTCTACTCCAGTCTAGCACCGATTATC
CATATCGTCAATGTTGGGACTGCTGCAAAACAATCATATGCTAATATCACTGACATCCACGATGGA
CTAGATTTTTCACAGCATGAAGATGTTCGATATACATTTGGAATATTTTCTGTTAAATTCTCTTCT
GATGGCCGAGAGCTTGTTGCTGGCAGTAACGATGATTCAATATATGTTTATGACCTTGTGGCAAAC
AAACTAACGTTGCGTTTGCCTGCTCATCATTCTGATGTCAACACAGTAGCATTTGCTGACGAAACT
GGCCATCTCATATATTCTGGAAGTGATGATAATTTATGCAAGGTCTGGGATAGGCGATGTTTATCC
ACAGAAGAACCTGCTGGAGTTTTGACTGGGCATTTGCATGGCATTACTCATATTGATAGCCGTGGA
GATGGTCGGTGTTTCATATCAAATGGAAAAGACCAAGCTATCAAAATGTGGGACATCAGGAAAATG
ACATCCAATGCTGATAGTTATGAAGACAGAACCTCAAATTGGGACTATAGATATTCAAGATATCCA
CAACAGTATAAGCAACTAAAGCATCCCCATGATCAGTCAATAGCTACATACTGGGGCCATTCAGTT
CTTCGTACATTGATCCGTTGCTATTTTCTCCTGCATATAGCACAGGACAGAAGTACATATATACA
GGATCCTATGATTCTAGTGTTTGTATCTACGATGTGGTGAGCGGATCACAAGTTGCAAAACTCAAA
GGATATCATCAGCTGGCAATTCGAGACTGCAGTTGGCATCCCTTCGACCCTATGCTTGTCAGCTCA
TCCTGGGACGGCCGGGTTGCCAAGTGGTCCAGGTCTTCCTGTCAGCAAGAAGAGACTACTGATCTC
GATTGA SEQ ID NO: 238 Oryza sativa Orysa_WDR23-like translated polypeptide sequence
MGYGMSRMEEEYSEHEDQNNGGSNSQVNNEFLNTHNDIFHMTQIRSGPSESLRKSIGTSKDVISTT
RLLSGREINSSGNGKFSSVDRAFLLGRYLPVDGPEIVDRMDSRAYVSQFSADGSLFVAGFQGSHIR
IYDVDKGWKVHRDIHARSLRWTISDASLSPDQQFLVYSSLAPIIHIVNVGTAAKQSYANITDIHDG
LDFSQHEDVRYTFGIFSVKFSSDGRELVAGSNDDSIYVYDLVANKLTLRLPAHHSDVNTVAFADET
GHLIYSGSDDNLCKVWDRRCLSTEEPAGVLTGHLHGITHIDSRGDGRCFISNGKDQAIKMWDIRKM
TSNADSYEDRTSNWDYRYSRYPQQYKQLKHPHDQSIATYWGHSVLRTLIRCYFSPAYSTGQKYIYT
GSYDSSVCIYDVVSGSQVAKLKGYHQLAIRDCSWHPFDPMLVSSSWDGRVAKWSRSSCQQEETTDL
D FIGURE 26 (continued)

SEQ ID NO: 239 Pinus radiata Pinra_WDR23-like nucleic acid sequence
ATGAATACGGCAATGCATTTTGGTGCTGGTTGGCGATCGATTGCTGAGATGGGGTATACGATGAGC
AGACTAGAGATTGAGCCTGAGTCGTGTGAGGACGAGAAGAGCTTGGATGGGGTTGGTAACAGCCAG
GGACCGAATGAGTTGCCGAGATGCTTGGATCATGAGTTGGCGCATTTGACGAATCTGAAGTCGAGG
CCCCATGAACATTTGATCCGAGATTTCCCTGGGAGGCGGGCTCTGCCTGTTTCCACCGTTAAGATG
CTGGCGGGTCGAGAGTGTAATTATTCACGAAGAGGGAGGTTCTCCTCCGCTGATTGCTGTCACATG
CTGAGCAGATATGTGCCTGTTAATGGTCCTTCGCCCCTGGATCAGATGAATAGTCGAGCTTATGTT
TCGCAATTTTCAGCTGATGGTTCTCTATTTGTTGCTGGCTTTCAGGGTAGCCACATTAGAATTTAT
AATGTTGATAAAGGATGGAAATGTCAGAAGAACATTCTTACCAAGAGTTTACGGTGGACGATCACT
GATACATCTCTTTCTCCTGACCAACGTTACCTTGTGTATGCCAGTATGTCACCCATCGTCCATATT
GTTGACATCGGCTCCGCTGCTATGGATTCTCTTGCAAACATCACGGAGATCCATGAGGGTTTGGAT
TTTTCCGCTGACAGTGGACCATATTCTTTTGGAATCTTCTCTGTTAAATTTTCTACCGATGGACGA
GAAGTCGTCGCTGGAAGCAGCGACGATTCTATATATGTCTATGATCTTGTGGCAAATAAGCTTTCC
CTCAGAATTCCAGCACATGAGTCTGATGTGAACACAGTATGCTTTGCTGATGAAAGTGGTCATATA
ATTTATTCTGGGAGTGATGATACATACTGCAAGGTGTGGGATAGACGTTGCCTGAGTGCCAGAAAT
AAACCTGCAGGAGTTCTAATGGGACACCTTGAAGGCATTACGTTCATTGATAGCCGTGGTGATGGT
CGTTATTTCATATCAAATGGCAAAGATCAGACGATCAAACTTTGGGATATCCGGAAAATGGGCTCT
GATATCTGTCGTCGAGGCTTTAGGAATTTCGAATGGGATTACAGATGGATGGACTACCCACCCCGG
GCTAGGGATTCGAAACACCCTTTTGATCTGTCAGTGGCAACATATAAAGGCCATTCGGTGTTGCGT
ACTCTTATTCGGTGCTACTTCTCCCCAGTACATAGCACTGGTCAAAAGTATATCTACACTGGATCC
CATGATTCCTGTGTTTATATCTATGATGTGGTGACTGGAGCTCAAGTTGCGGCCCTCAAGCACCAT
AAATCGCCGGTCAGAGACTGCAGTTGGCACCCGGAGTACCCGATGATTGTGAGCTCTTCTTGGGAT
GGGGATATTGTGAAATGGGAATTCTTTGGGAACGGAGAAACTGAGATCCCGGCGATGAAGAAGAGG
ATCCGGAGGCGGCATTTGTATTAA

SEQ ID NO: 240 Pinus radiata Pinra_WDR23-like translated polypeptide sequence
MNTAMHFGAGWRSIAEMGYTMSRLEIEPESCEDEKSLDGVGNSQGPNELPRCLDHELAHLTNLKSR
PHEHLIRDFPGRRALPVSTVKMLAGRECNYSRRGRFSSADCCHMLSRYVPVNGPSPLDQMNSRAYV
SQFSADGSLFVAGFQGSHIRIYNVDKGWKCQKNILTKSLRWTITDTSLSPDQRYLVYASMSPIVHI
VDIGSAAMDSLANITEIHEGLDFSADSGPYSFGIFSVKFSTDGREVVAGSSDDSIYVYDLVANKLS
LRIPAHESDVNTVCFADESGHIIYSGSDDTYCKVWDRRCLSARNKPAGVLMGHLEGITFIDSRGDG
RYFISNGKDQTIKLWDIRKMGSDICRRGFRNFEWDYRWMDYPPRARDSKHPFDLSVATYKGHSVLR
TLIRCYFSPVHSTGQKYIYTGSHDSCVYIYDVVTGAQVAALKHHKSPVRDCSWHPEYPMIVSSSWD
GDIVKWEFFGNGETEIPAMKKRIRRRHLY

SEQ ID NO: 241 Populus tremuloides Poptr_WRD23-like nucleic acid sequence
ATGTATTTTTTTGCTAGAAGAACTTCGGTAGACGAAATGGGTTACGCTATGAGCAGACTGGAGACT
GAATCTGAACTCTGTGATGGTGGCAAGACCATTCCTGAGGCTGGTAGCAGCAAGAGAGCCAGCAAT
TGGTTGAATAACTTAGACCATGAAATTGCTCAGGTTACGAAGTTGAAATCTAGTCCGCATAAACAG
CTGGCCGAACTTGTTCCCGGCATGCATAAGTCATCTGTTTCCACTGTTAAGATGTTGGTTGGTCGA
GAAGCTAATTATTCAGCAAGGGGAAGATTCTCTGCAGCTGATCGTTGTCACATGCTTAGCAGATAT
TTGCCTGTCAATGGACCTTGGCTTGTTGACCAGATGAGTACCCGAGCCTATGTCTCGCAGTTTTCA
GCTGATGGCTCTCTATTTGTTGCTGGGTTTCAGGGAAGCTATATTAGAATATACAATGTGGAGAAG
GGGTGGAAAGTTCAGAAGAACATTCTTGCCAAAAGTTTGCGTTGGACTGTTACCGATACATCTCTT
TCCCCAGATCAGCGCCATCTCGTTTATGCAAGCATGTCACCTATTGTCCATATTGTTGATGCTGGG
TCTGCCGAAACAGAGTCGCTTGCAAACGTTACGGAGTTTCATGACGGATTGGACTTTTCTTCTGGT FIGURE 26 (continued)

```
GATGGGGGCTATTCTTTTGGAATCTTCTCTGTGAAATTTTCCACTGATGGGCGAGAACTTGTTGCA
GGAAGTAATGATGACTCCATATATGTCTACGACCTTGAACAAAATAAGCTCTCCCTCAGAATTTTG
GCACACACGTCTGATGTTAACACTGTATGTTTTGCTGATGAAAGTGGCCACCTTATCTTTTCTGGG
AGTGATGATAATCTTTGCAAGGTGTGGGATAGACGCTGCTTTATTGCAAAAGGGAAGCCAGCTGGA
GTCCTAACAGGACACTTAGAAGGCATAACATTTATTGACAGCCATGGAGATGGTCGGTATTTTATC
TCAAATGGTAAAGATCAGACTATCAAACTTTGGGATATTCGGAAAATGGCCCCTAATGCTACTAGC
TATTCAGGGCTTAGGAATTATGAATGGGACTACAGGTGGATGGACTACCCATATGAGGCAAGAGAT
TTGAAACACCCCTGCGATCAATCAGTAGCCACATATAAAGGTCATTCGGTTCTGCGCACTCTTATC
CGCTGCTACTTTTCTCCTGTATATAGTACTGGCCAGAAGTACATCTACACTGGATCTCATGATTCT
TGTGTTTATATTTATGACTTGGTGACTGGAGAACTAGTTTCATTACTACAACATCATAAATCACCT
GTAAGAGATTGTAGTTGGCACCCATATTATCCCATGCTCGTCAGCTCTTCTTGGGACGGAGATGTC
GTAAAATGGGAGTTTCCTGGCAATGGAGAAGCTCCAGTCCCTTCAACCAAGAAGAGAATTCGAAGG
AGACAATTTGATTGA
```

SEQ ID NO: 242 Populus tremuloides Poptr_WRD23-like translated polypeptide sequence
```
MYFFARRTSVDEMGYAMSRLETESELCDGGKTIPEAGSSKRASNWLNNLDHEIAQVTKLKSSPHKQ
LAELVPGMHKSSVSTVKMLVGREANYSARGRFSAADRCHMLSRYLPVNGPWLVDQMSTRAYVSQFS
ADGSLFVAGFQGSYIRIYNVEKGWKVQKNILAKSLRWTVTDTSLSPDQRHLVYASMSPIVHIVDAG
SAETESLANVTEFHDGLDFSSGDGGYSFGIFSVKFSTDGRELVAGSNDDSIYVYDLEQNKLSLRIL
AHTSDVNTVCFADESGHLIFSGSDDNLCKVWDRRCFIAKGKPAGVLTGHLEGITFIDSHGDGRYFI
SNGKDQTIKLWDIRKMAPNATSYSGLRNYEWDYRWMDYPYEARDLKHPCDQSVATYKGHSVLRTLI
RCYFSPVYSTGQKYIYTGSHDSCVYIYDLVTGELVSLLQHHKSPVRDCSWHPYYPMLVSSSWDGDV
VKWEFPGNGEAPVPSTKKRIRRRQFD
```

SEQ ID NO: 243 Prunus armeniaca Pruar_WRD23-like (LEC14B) nucleic acid sequence
```
ATGAGTTACAGAACAAGGTTTGGAAAAGATAATAGCGCTTGTGATAGTGGAAATGCTGTTGAAGGT
TCTGGTTCAAGTAAAGGACCCAATGAAGTATCAAATGATTTTGATCATGAAATTGCTCAACTCACT
AAGCATAGATCAAGACCCCATCAGCTTTTGAGCCAGGACATGCCTGGAAAGTCGAGGTTACTGGTT
TCAACAATGAAAATGTTGGTTGGTCGTGAAAGTAATCATTCAGGACGTGGGAGATTCTCGTCTGCT
GACGGTTGCCATGTTTTGAGCCGGTATCTGCCCATCAATGGTCCTTGGGGGTGGACCAGTCAACA
AGTCCTGCTTATGTTTCTCAATTTTCAAATGATGGTTTGTTTTTGTTGCTGGATTTCAGGGCGGC
CATATTAGAATATATAATGTTGATAAGGGATGGAAAGTTCAGAAGGACATCCTAACCAAAAGCTTG
AGATGGACAATTACTGATACATCTCTATCTCCAGATCAACGTTATCTTGTTTATGCTAGCATGACA
CCCATTGTCAATATTGTCAATGTTGGATCTTCTATGACAGAGTCACTTGCAAATGTTACGGAAATT
CATGAAGGTCTGGATTTTTCTGTTGGTGGTGATGAGGACGAATTTGGAATTTTCTCAGTTAGATTT
TCAACTGATGGGCGAGAGCTTGTAGCTGCAAGTAGAGATGCTTCAATATATGTTTATGATCTCCAA
GCAAATAAAGTTAACCTCCGAATACCAGCACACTCGTCTGATGTAAACACTGTATGCTTTGCGGAT
GAGACTGGACATCTCATATATTCTGGCAGTGACGATAATCTCTGTAAGGTTTGGGATAGACGCTGC
TTTAATCACAAAGGACAGCCAGCTGGGGTCCTGATGGGACATCTTGAAGGTGTTACATTTATTGAT
AGTAGGGGAGATGGGCGTTACTTCATATCAAATGGGAAGGACCAGACTACCCAACTCTGGGATATA
AGAAAGATGTCCTCTAGAGCCATGTACAGCCCAAGGCTTAGAGATCATGACTGGGATTACAGATGG
ATGGAGTACCCAGCTCATGCAAAACTTTGAAACATCCAAATGATCAGTCACTGGCTACATATAGA
GGTCATGGAGTCCTGCGTACTTTAATTCGCTGTTACCTTCTCCAGCATATAGTACTGGACAAAAG
TACATCTACACTGGATCTAGTGATCATTGTGTCTATATATATGATCTGGTGACCGGTGCTCAAGTT
GCGAGACTCAACCATCACGAAGGACCTGTAAGAGACTGTAGTTGGCATCCTCTCTATCCGATGTTG
GTCAGCTCTTCTTGGGATGGGACGATTGCCAGATGGGAATTTCCTGGGGATGACCAAGTACCCACC
CTGGAGAGGCCGAGAGCGCGCCGGAAGGAGAGGCTACTATAA
```

FIGURE 26 (continued)

SEQ ID NO: 244 Prunus armeniaca Pruar_WRD23-like (LEC14B) translated polypeptide sequence
MSYRTRFGKDNSACDSGNAVEGSGSSKGPNEVSNDFDHEIAQLTKHRSRPHQLLSQDMPGKSRLLV
STMKMLVGRESNHSGRGRFSSADGCHVLSRYLPINGPWGVDQSTSPAYVSQFSNDGLFFVAGFQGG
HIRIYNVDKGWKVQKDILTKSLRWTITDTSLSPDQRYLVYASMTPIVNIVNVGSSMTESLANVTEI
HEGLDFSVGGDEDEFGIFSVRFSTDGRELVAASRDASIYVYDLQANKVNLRIPAHSSDVNTVCFAD
ETGHLIYSGSDDNLCKVWDRRCFNHKGQPAGVLMGHLEGVTFIDSRGDGRYFISNGKDQTTQLWDI
RKMSSRAMYSPRLRDHDWDYRWMEYPAHAKTLKHPNDQSLATYRGHGVLRTLIRCYLSPAYSTGQK
YIYTGSSDHCVYIYDLVTGAQVARLNHHEGPVRDCSWHPLYPMLVSSSWDGTIARWEFPGDDQVPT
LERPRARRKERLL

SEQ ID NO: 245 Saccharum officinarum Sacof_WRD23-like II nucleic acid sequence
ATGCGCGGAGTGCGGCGGAGCGCGCGCGGGGAATCGTCCCGGAAGGCGGCGGCGGACCGGGACCGG
GAGGTGGAGCGGTTCACGCTGTGCGCCAAGATGTCCCACCTCACCAGGACCACGTCGGAGCCGTGC
CGCAGGGCTCGCGGCGCCGCTCCGGCGCTCCGGAAGAGGCCCTTCTCGGCGTTCGAGCTGGTGTCG
GCGAGGGAGGCCGGCCGCGCGGGCGGCGCCGGGTTCTCCGCGGCCGACCGAGCCTACGTCGGCAGG
CAGCACATCCCCACCAAGGGGCCCTGGGGCGTCGACGACGTGGACAGCGAGGCCTACGTCTCGCAG
TTCTCCGCTGATGGCTCCTTGCTCATCGCTGGGTTCGGGGAAGCCGCATCAGAGTCTACGACGCC
GAGAAAGGGTGGAAGATTCATAAGGATATAAGCTGCCAAATGGTGCACTGGACGGTTTCAGACATT
GCTCTCTCACCTGACCAACGATTCCTTGCCTATGCAAGTTTGTCGCCTACTGTTCACATTGTGAAC
GTGCAGAGTGCTGGAAAGGAATCACATGCTAATATTACTGAAATTCATGAGGGACTGGATTTAACT
GGTGGTGATGAGGATGAGGACTTTGGAATATTTTCTGTTAAATTCTCAAAAGATGGTAAAGAAATT
GTTGTTGGGAACAATGAAAGATCAATATATGTTTATGACCTTGCAACAAATAAAGTGTCAGCCCGC
ATCCGTGCTCATAAAGCTGATGTCAATGCTGTTACCTTCGCTGATGAAAGTGGAAATGTGTTGTAC
TCTGGAAGTGATGATAGTTTCTGTAAGGTGTGGGACAGACGTTGCCTTTCAGGGGAAAAGTCAGCA
GGTACTTTAACAGGTCATTTAGATGGAGTTACATTTATCGATAGCCGTGGTGATGGGCGTTATTTC
ATCTCCAATTGCAAGGATCAGAGAATCAAACTTTGGGACATCAGGAAAATGTCTTCCGTCGTGAGA
GCTCGCCCAGTGAGTCTAGTGGACTGGGACTATAGGTGGGAGCTATTTCCATCAGAAGCCCACAAT
TTTAAGCATCCAGATGATCAGTCTGTGGCCACATACAGAGGCCATTCAGTTCTGCGAACACTTATC
CGTTGCTATTTCTCCCCTGTGCACAGCACGGGTCAGAGGTACATATACACAGGATCCAGTGACAAG
TCTGTACATATTTATGATGTGGTAAGCGGGAAGACTGTCAAGAGGCTTTCTTGGCATGGCTCGATC
ATCAGAGACTGCACCTGGCATCCATACTACCCAACGCTCGTCAGCTCCTCCTGGGACGGCTATGTT
GCCCGCTGGGAGGCATCAGGCGACGACGACGACCCTTCAGTGCTCGTCCACGACGAGAAGAGGGCA
ACCCGTTACTTTCGGAGATACGCCAATCCCTTCACAGATCCCTTCATGTGA

SEQ ID NO: 246 Saccharum officinarum Sacof_WRD23-like II translated polypeptide sequence
MRGVRRSARGESSRKAAADRDREVERFTLCAKMSHLTRTTSEPCRRARGAAPALRKRPFSAFELVS
AREAGRAGGAGFSAADRAYVGRQHIPTKGPWGVDDVDSEAYVSQFSADGSLLIAGFRGSRIRVYDA
EKGWKIHKDISCQMVHWTVSDIALSPDQRFLAYASLSPTVHIVNVQSAGKESHANITEIHEGLDLT
GGDEDEDFGIFSVKFSKDGKEIVVGNNERSIYVYDLATNKVSARIRAHKADVNAVTFADESGNVLY
SGSDDSFCKVWDRRCLSGEKSAGTLTGHLDGVTFIDSRGDGRYFISNCKDQRIKLWDIRKMSSVVR
ARPVSLVDWDYRWELFPSEAHNFKHPDDQSVATYRGHSVLRTLIRCYFSPVHSTGQRYIYTGSSDK
SVHIYDVVSGKTVKRLSWHGSIIRDCTWHPYYPTLVSSSWDGYVARWEASGDDDDPSVLVHDEKRA
TRYFRRYANPFTDPFM

FIGURE 26 (continued)

SEQ ID NO: 247 Triticum aestivum Triae_WRD23-like nucleic acid sequence
ATGGGTTATGGCATGAGTAGGCTACATGAGGGATACAGTGAGCCTGAAGGGCTGAATAGTGATGGA
TCTAGTTCAGTCGAAGTGAATAATGATTTCTCAAAGTTACACAATGATATTTTCCATATGACTCGA
CTAAGATCAGGACCTAGTGAAAGCATCCGCAAGTCCATGGATAGAGTCTCAGTGACTAGGTTGTTA
CGTGGAAGGGAAGTTAATTCTTCAGGAAATGGAAAGTTCTCTCCGGTTGATCGTGCATTCGTTCTT
GGTCATTATCTTCCAGTGGATGGTCCTGAAACGGTGGATACAATGGATTCACGAGCTTATGTTTCA
CAGTTTTCTGCCGATGGTTCTCTTTTTGTTGCTGGTTTTCAGGGAAGCCACATAAGAATATATGAT
GTCGATAAAGGTTGGGAAATACACAAGGACATTCATGCTAGAAGTTTGAGATGGACAATTAGTGAT
GCAGCGTTATCACCTGATCAAAGGTTCCTTGTCTACTCTAGTCTGGCACCCATTATCCATATTGTC
AATGTTGGCACTGCTTCAAGAGAATCATATGCTAATGTCACTGACATCCATGATGGATTAGATTTT
TCAGAGCATGAAGATGTTAGATATTCATTTGGACTCTTTTCTGTTAAATTTTCCACTGATGGGCGG
GAGCTTGTTGCTGGCAGTAATGATGATTCAATATATGTCTATGACCTTCAGACCAACAAAGTGACA
TTGCGTTTGCCTGCCCATACATCTGATGTCAACACAGTAGCATTTGCTGATGAATCTGGTAACCTA
CTTTATTCTGGAAGCGATGATAACTTGTGCAAGGTCTGGGACAGACGTTGTTTGTCCACAGGGGAA
GCGGCTGGGGTTTTGACTGGACATCTGCATGGCATTACTCATATTGACAGCCGTGGAGATGGTCGA
TGTTTCATATCAAATGGAAAAGATCAAGCTATTAAGATGTGGGACATCCGGAAAATGACATCCAAT
GCTGATGGTTCCGAAAACAGAGTCCCTGCCTGGGACTACAGATATTCAAGATATCCACAACAGTAC
AAGCAACAAAAGCATCCACATGACCAGTCAGTAGCTACATACCGGGGCCATTCAGTTCTCCGTACA
TTGATTCGTTGCTATTTTCTCCCACATATAGCACAGGACAGAAGTACATATATACAGGATCTTAT
GATGCTAGTGTCTGCATCTATGATGTGGTAAGTGGGTCGCAAGTTGCCAAACTGCAAGGACATCAT
CATTTGGCAGTTCGAGACTGCAGCTGGCATCCGTCCGATCCAATGCTTGTCAGTTCATCATGGGAC
GGCCAGGTTGCCAGATGGTCCAGGACTCGCTCCAAGCAAGATACTTGTGAACTCGATTAA

SEQ ID NO: 248 Triticum aestivum Triae_WRD23-like translated polypeptide sequence
MGYGMSRLHEGYSEPEGLNSDGSSSVEVNNDFSKLHNDIFHMTRLRSGPSESIRKSMDRVSVTRLL
RGREVNSSGNGKFSPVDRAFVLGHYLPVDGPETVDTMDSRAYVSQFSADGSLFVAGFQGSHIRIYD
VDKGWEIHKDIHARSLRWTISDAALSPDQRFLVYSSLAPIIHIVNVGTASRESYANVTDIHDGLDF
SEHEDVRYSFGLFSVKFSTDGRELVAGSNDDSIYVYDLQTNKVTLRLPAHTSDVNTVAFADESGNL
LYSGSDDNLCKVWDRRCLSTGEAAGVLTGHLHGITHIDSRGDGRCFISNGKDQAIKMWDIRKMTSN
ADGSENRVPAWDYRYSRYPQQYKQQKHPHDQSVATYRGHSVLRTLIRCYFSPTYSTGQKYIYTGSY
DASVCIYDVVSGSQVAKLQGHHHLAVRDCSWHPSDPMLVSSSWDGQVARWSRTRSKQDTCELD

SEQ ID NO: 249 Triticum aestivum Triae_WRD23-like II nucleic acid sequence
ATGGCGGCGGCAGGGAGACTGCGGGGACGGCGGCGGACAAAGGAGGTGGAGCGCGAGCCCGAGCCG
TTCACCATCGAGGAGGAGGTGTCCCACCTCACCCGGGTCCGGTCGGAGCCGTGCCCCGGCACCCGC
GCCGCCATCCATGGCGCCAAGCGGAAGAGGGACGTCTCGGCTTTCGAGATGCTGTCGTCGAGGGAG
TCCGGCCTCTCGGGAGGCGGCGGGTTCTGTTCGGCCGACCGCGCCTACGCCGCGGGAAGCACCTC
CCGTCGGAAGGACCCTGGTGCGTGGAAGACATGGATAGCGAGGCCTATGTCTCGCAGTTCTCCAGC
GATGGCTCGATGCTCGTTGCCGGGTTCGGGGAAGCCGCATCAGAGTTTACGATGTCGATAGAGGG
TGGAAGGTTCATAAGAACATAAGCTGCAGAAGTATGAGGTGGACGGTTTCAGATATTGCGCTCTCC
CCTGACCAGCGATATCTTGCCTATTCCAGTTTGTCGCCTATTGTTCACATTGTTAATGTGCAGAAT
GCTGGAAGGGAATCGGATGCTAATGTTACTGAAATTCACGATGGTTTGGAATTCTGTGATGACGAT
GAATACTCTTTCGGGATATTCTCTGTGAAATTTCGAAAGATGGTAGAGAAGTAGTTGTTGGGAAC
AATGATTGTTCAATATATGTCTATGATCTTGGAGCAAATAAAGTGTCAGACCGTATCCGTGCTCAT
ACGTCTGATGTCAACACGGTCACCTTTGCTGATGAAAGTGGCAATTTATTGTACTCTGGAAGTGAT FIGURE 26 (continued)

```
GATAATCTCTGTAAGGTCTGGGATAGGCGTTGCCTTGTAAGAGAGAAACCAGCAGGTGTTTTGACA
GGTCACTTAGATGGGATTACATGTATTGATAGCCGTGGTGATGGGCGTTATCTAATCTCCAACTGC
AAGGATCAGACTATCAAACTTTGGGACATCAGAAAGATGTCCGCCACCGTAAAAGGACGACAACCA
AGATTGTATGACTGGGACTACAGATGGATGTCGTTCCCGTCACACGCTAGATATTATAAGCATCCA
AATGATCTATCTCTGGCAACATACAGGGGTCATTCAGTTCTGCGGACACTTATCCGCTGCTACTTC
TCTCCAATGCACAGCACGGGCCAGAGGTACATATACACTGGATCAAGTGACGATTCAGTGCATATT
TACGATGTGGTAACAGGGGCGACCGTCAAGAAGCTCTCGTGGCACGGTTCGATCATCAGAGACTGC
ACCTGGCATCCTTACCGTCCAACGCTCGTAAGCTCTTCCTGGGACGGCTATCTGGCCCGGTGGGAG
GCATCAGGCAACAATGAGGACCCCTCGGTGCTCACGTGCGACGAGCAGAGGACTAGCCCTTACGAC
CAGACATACGGGCTCTCTTTTGCCCTGTAG
```

SEQ ID NO: 250 Triticum aestivum Triae_WRD23-like II translated polypeptide sequence
```
MAAAGRLRGRRRTKEVEREPEPFTIEEEVSHLTRVRSEPCPGTRAAIHGAKRKRDVSAFEMLSSRE
SGLSGGGGFCSADRAYAAGKHLPSEGPWCVEDMDSEAYVSQFSSDGSMLVAGFRGSRIRVYDVDRG
WKVHKNISCRSMRWTVSDIALSPDQRYLAYSSLSPIVHIVNVQNAGRESDANVTEIHDGLEFCDDD
EYSFGIFSVKFSKDGREVVVGNNDCSIYVYDLGANKVSDRIRAHTSDVNTVTFADESGNLLYSGSD
DNLCKVWDRRCLVREKPAGVLTGHLDGITCIDSRGDGRYLISNCKDQTIKLWDIRKMSATVKGRQP
RLYDWDYRWMSFPSHARYYKHPNDLSLATYRGHSVLRTLIRCYFSPMHSTGQRYIYTGSSDDSVHI
YDVVTGATVKKLSWHGSIIRDCTWHPYRPTLVSSSWDGYLARWEASGNNEDPSVLTCDEQRTSPYD
QTYGLSFAL
```

SEQ ID NO: 251 Vitis vinifera Vitvi_WDR23-like nucleic acid sequence
```
ATGTATTTTACAGCCAGTGAGGGTGCTGCTAATGAAATGGGGTATGCCATGAGTAGATTGGAGCTA
GATTCTGATTTCTGTGATGCTGGCAAGGACATCCATGGAAATGATAACACTGAAAGACTCAACAAA
GAATTGAATCATTTAGATCATGAAATTTCCAGCTCACAAAGCTTAGATCGGGACCTCACGAATGT
CTGAGTCAGATTATTCCTGGAAAGCGGGACTCACCTGTTTCGACGGTTAAGATGCTGGCGGGTCGA
GAAGGGAATTATTCAGGAAGGGGAAGGTTCTCATCAGCTGATTGTTGTCATATGTTAAGTAGATAT
TTGCCTGTCAATGGTCCTTGGCTTGTGGACCAAATGACAAGTCGAGCTTATGTGTCGCAATTTTCT
GCTGATGGTTCCCTGTTTGTTGCAGGGTTTCAGGGAAGCCATATTAGAATATACAATGTGGATAGA
GGGTGGAAAGTGCAGAAGAATATTCTTGCAAAAAGCTTGCGATGGACAGTCACTGATACATCTCTC
TCCCCTGATCAACGCCATCTTGTTTATGCCAGCATGTCACCTATTGTCCATATTGTTAATATTGGA
TCTGCTGCAACAGAATCTCTTGCAAACATTACGGAGATTCATGATGGTTTGGATTTTCTGCTGCT
GATGATGAGGGTTATTCTTTCGGAATCTTCTCAGTGAAATTTTCCACAGATGGGCGAGAGCTTGTA
GCTGGAAGTAGTGATGATTCAATATATGTTTATGATCTTGAAGCAAATAAGCTTTCCCTTAGAATT
TCGGCACACACGTCTGATGTCAATACTGTATGCTTTGCTGATGAAAGTGGGCATCTTATTTATTCC
GGGAGTGATGATAGTTTGTGCAAGGTTTGGGACAGACGTTGCTTCATATCAAAAGGGAAGCCTGCA
GGAGTCCTGATGGGACACCTAGAAGGAATTACTTTTATTGATAGCCGTAGAGATGGTCGTCATCTC
ATTTCAAATAGTAAAGACCAGTCTATCAAACTTTGGGACATCCGAAAAATGTCCTCCAATGCTACT
TGCACTCCAGGGTTCAGGAATTATGAATGGGATTATAGATGGATGGATTATCCAACCCAGGCAAGA
GAGTTGAAACACCCATGTGATCAATCACTTTCCACTTATAAAGGTCATTCAGTCCTGCGTACTCTC
ATACGCTGCTACTTCTCCCCGTCTTATAGCACTGGTCAGAAATACATCTACTCTGGATCTAGCGAT
TCTTGCATTTATATTTATGATTTGCTGACCGGAGCCCAAGTTGCAACACTGGAGCACCATAAATCA
GTCGTAAGAGATTGTAATTGGCACCCTAATTATCCAATCCTGGTTAGCTCTTCATGGGATGGAGAC
ATTGTCAAGTGGGAATTCCCTGGGAATGGAGAGCCCCCTTTGATCAAGAAACGAATCCGGCGGAAA
TATTTATAG
```

SEQ ID NO: 252 Vitis vinifera Vitvi_WDR23-like translated
polypeptide sequence
MYFTASEGAANEMGYAMSRLELDSDFCDAGKDIHGNDNTERLNKELNHLDHEISQLTKLRSGPHEC
LSQIIPGKRDSPVSTVKMLAGREGNYSGRGRFSSADCCHMLSRYLPVNGPWLVDQMTSRAYVSQFS
ADGSLFVAGFQGSHIRIYNVDRGWKVQKNILAKSLRWTVTDTSLSPDQRHLVYASMSPIVHIVNIG
SAATESLANITEIHDGLDFSAADDEGYSFGIFSVKFSTDGRELVAGSSDDSIYVYDLEANKLSLRI
SAHTSDVNTVCFADESGHLIYSGSDDSLCKVWDRRCFISKGKPAGVLMGHLEGITFIDSRRDGRHL
ISNSKDQSIKLWDIRKMSSNATCTPGFRNYEWDYRWMDYPTQARELKHPCDQSLSTYKGHSVLRTL
IRCYFSPSYSTGQKYIYSGSSDSCIYIYDLLTGAQVATLEHHKSVVRDCNWHPNYPILVSSSWDGD
IVKWEFPGNGEPPLIKKRIRRKYL SEQ ID NO: 253 Zea mays Zeama_WDR23-like nucleic acid sequence
ATGCAAGGAAGGATGCGAGGCGCGCGGCGGAGCGCGCGCGGGGAATCGTCCCGGAAGGCGGCGGGC
CGCGAGGTGGAGCCATTCACGCTGTGCGGCGAGATGTCCCATCTCACCAGGGCCACGTCAGAGCCG
TGCCGCAGGGCTCGCGGCGCCGCCTTCGCCCGCCGGGCGAGGCCCTTCTCGGCGTACGAGCTGGTG
TCGGCGCGGGAGGCCGGCCGCGCGGGCGGCGCCGGGTTCTCCGCGGCCGATCGAGCCTACCTCGGC
AGGCAGCACATCCCCACCAAGGGGCCGTGGGCGTCGACGACGTGGAAAGCGAGGCCTACGTCTCG
CAGTTCTCCGCCGATGGCTCGTTGCTCATCGCGGGGTTTCGGGGAAGCCGCATCAGAGTCTACGAC
GCCGAGAAAGGGTGGAAGATCCACAAGGATATAAGCTGCAGAAGTGTGCACTGGACGGTTTCAGAT
ATTGCTCTCTCACCTGACCAACGATTCCTTGCCTATGCAAGTCTGACACCTATTGTTCACATTGTG
AATGTTCAGAATGCTGGAAAGGAATCACATGCTAATATTACTGAAATTCATGAGGGATTGGATTTA
ACCGGTGGTGATGAGGATGAGGACTTTGGAATATTTTCTGTTAAATTCTCCAAAGATGGTAAAGAA
GTTGTTGTTGGGAACAATGAAAAGTCAATATATGTTTATGACCTTTCAGCAAATAAAGTGTCAGCC
CGCATCCGTGCTCATAAAGCTGATGTCAATGCTGTTACCTTCGCTGATGAAACTGGAAACGTGTTG
TACTCTGGAAGTGATGATAGTCTCTGTAAGGTGTGGGACAGGCGTTGCCTTTCAGGGGAAAAGTCA
GCAGGTATTTTGACAGGTCATTTAGATGGAGTTACATTTATCGATAGCCGTGGTGATGGGCGTTAT
TTCATCTCTCATTGCAAGGATCAGAGAATCAAACTTTGGGACATCAGGAAAATGTCTTCCGTCGTG
AGATCTCGCCCAGTGAGTCTAGTGGACTGGACTATAGGTGGATGCCATTCCATCAGAAGCTCAT
AATCTTAAGCATCCAGGTGATCAGTCTGTGGCCACATACAGAGGCCATTCAGTTTTGCGAACACTT
ATCCGTTGCTATTTTTCCCCTGTGCACAGCACGGGTCAGAGGTACATATACACGGGATCCAGTGAC
AAGTCTGTACATATTTATGACGTGGTAACCGGGGAGGCTGTCAAGAGGCTTTCGTGGCATGGCTCC
ATCATCAGAGACTGCACCTGGCATCCATACTACCCAACGCTCGTCAGCTCCTCCTGGGACGGCTTC
GTTGCCCGGTGGGAGGCCTCGGGCGACGACGACGACCATTCGGTGCTCGTTGCCGACGAGATGAGA
GGAAGCCCTTACTACCGGAGATACGGCGATCCCTTGGTGATGTAG SEQ ID NO: 254 Zea mays Zeama_WDR23-like translated polypeptide
sequence
MGYGMSRLDDEYYEAEGQNTGGSGSVQVNDEFATLHNDIFHMTRMRSGLTESYKSMGTNRGIISTA
KLLSRREIDCSGKGMFSSGDRAFVLGRHVPMNNPELLDRMDSRAYVSQFSADGTLFVAGFQGSHIR
IYDVDRGWSIHKDIHARCLRWTISDVSLSPDQRYLAYSSLAPIIHIVNVGNAARESYANVTDIHDG
LDFSQHEDVQYSFGIFSVKFSSDGRELVAGSNDDSIYVYDLHANKLTLRLSAHTSDVNTVAFADET
GHLIYSGSDDTLCKVWDRRCLSAGQAAGVLTGHLHGITHIDSRGDGRSFISNGKDQAIKLWDIRKM
MSNADSCADGAPAWDYRYSRYPHQHKQLKHPHDQSIATYRGHTVLRTLIRCYFSPSYSTGQKYIYT
GSYDSNVCIYDVVSGSQVAKLKWHQMAIRDCSWHPFEPTLVSSSWDGRVVKWTSARDEGASDVD FIGURE 26 (continued)

SEQ ID NO: 255 Zea mays Zeama_WDR23-like II nucleic acid sequence
ATGGGTTATGGCATGAGTAGGCTAGACGATGAATACTATGAGGCTGAAGGGCAGAATACTGGTGGA
TCTGGCTCAGTTCAAGTGAACGATGAGTTTGCAACACTACATAATGATATTTTTCATATGACCCGA
ATGAGATCAGGACTTACTGAAAGCTACAAGTCCATGGGTACCAACAGAGGCATAATATCAACTGCC
AAGTTATTATCTCGAAGGGAAATTGATTGTTCTGGAAAGGGGATGTTCTCTTCTGGTGACCGTGCA
TTTGTTCTAGGTCGTCATGTTCCGATGAACAATCCTGAATTATTGGATAGGATGGATTCTCGTGCT
TACGTTTCACAGTTTTCTGCTGATGGTACTCTTTTTGTTGCTGGTTTTCAGGGAAGTCACATAAGA
ATATACGATGTTGATAGAGGCTGGAGCATACACAAAGACATTCATGCTAGGTGTTTAAGATGGACA
ATCAGTGATGTATCCTTATCACCTGATCAGCGGTATCTTGCCTACTCTAGTCTGGCACCTATTATC
CATATTGTCAATGTTGGGAATGCGGCAAGAGAATCCTATGCTAACGTCACTGACATCCATGATGGA
TTGGATTTTTCACAGCATGAAGATGTTCAATATTCATTTGGAATATTTTCTGTAAAATTTTCCTCT
GATGGACGGGAACTTGTTGCTGGCAGCAATGATGACTCAATATATGTCTATGATCTTCATGCAAAC
AAATTGACATTACGTTTATCTGCTCATACATCTGATGTCAATACAGTAGCATTTGCTGATGAAACC
GGCCATCTCATATATTCTGGAAGTGACGACACTTTATGCAAGGTCTGGGACAGGCGGTGTTTGTCC
GCAGGACAGGCTGCCGGAGTTTTGACTGGACATTTGCATGGGATAACACATATTGATAGTCGTGGA
GATGGCCGAAGTTTCATATCCAATGGAAAAGATCAAGCAATCAAACTGTGGGATATCAGGAAAATG
ATGTCCAATGCTGATAGTTGTGCAGATGGAGCCCCAGCCTGGGACTACAGATATTCAAGGTATCCG
CATCAACATAAACAGTTAAAGCATCCGCATGATCAGTCAATAGCGACGTACCGTGGACATACAGTC
CTCCGGACATTGATCCGTTGCTACTTTTCTCCTTCGTATAGCACTGGGCAAAAGTACATATATACA
GGGTCGTATGATTCCAATGTTTGCATCTATGATGTGGTAAGTGGATCCCAGGTTGCGAAGCTGAAA
TGGCATCAAATGGCGATTCGGGACTGCAGTTGGCACCCATTTGAGCCCACGCTTGTGAGCTCATCC
TGGGACGGCCGGGTAGTGAAATGGACCAGCGCACGTGATGAAGGGGCTTCTGATGTCGATTGA

SEQ ID NO: 256 Zea mays Zeama_WDR23-like II translated polypeptide sequence
MQGRMRGARRSARGESSRKAAGREVEPFTLCGEMSHLTRATSEPCRRARGAAFARRARPFSAYELV
SAREAGRAGGAGFSAADRAYLGRQHIPTKGPWGVDDVESEAYVSQFSADGSLLIAGFRGSRIRVYD
AEKGWKIHKDISCRSVHWTVSDIALSPDQRFLAYASLTPIVHIVNVQNAGKESHANITEIHEGLDL
TGGDEDEDFGIFSVKFSKDGKEVVVGNNEKSIYVYDLSANKVSARIRAHKADVNAVTFADETGNVL
YSGSDDSLCKVWDRRCLSGEKSAGILTGHLDGVTFIDSRGDGRYFISHCKDQRIKLWDIRKMSSVV
RSRPVSLVDWDYRWMPFPSEAHNLKHPGDQSVATYRGHSVLRTLIRCYFSPVHSTGQRYIYTGSSD
KSVHIYDVVTGEAVKRLSWHGSIIRDCTWHPYYPTLVSSSWDGFVARWEASGDDDDHSVLVADEMR
GSPYYRRYGDPLVM

SEQ ID NO: 257 Citrus sinensis Citsi_WDR23-like partial nucleic acid sequence
ATGTTCGTAACAGCAAGTGGAGTTGACTTTGACGAAATGGGATATGCCATGAGTAGATTCGAGATA
GAATCTGAATTCTATGATGCTGCCGATACTGTCAATCAAGCTAGTAATAGTCGTAGCAAATTCAAG
AAACCCTTGAGTGCTTTAGACCATGAAATTGCCCAGCTCACGAAGCTGAAATCGGAACCCAAGGAG
CATTTTAGCAAAGAAGTACCTGGGAAGCGGCACTTGCCTGTTTCCACTGTGAAAATGTTGGCTGGT
AGGGAAGGCAATTATTCAGGAAGAGGGAGGTTCTCAGCTGCAGATTGTTGTCATATGCTTAGTAGA
TATTTGCCTGTTAATGGGCCCTGGCCTGTGGACCAGACAACTAGCCGAGCATATGTCTCTCAGTTT
TCGGCTGATGGTTCTTATTGTTGCTGGATTTCAGGCTAGTCAAATTAGAATCTATGATGTGGAG
AGAGGTTGGAAAATACAGAAAGACATTCTTGCTAAAAGTTTGCGTTGGACAGTCACAGATACATCT
CTTTCCCCGGATCAGCGCCATCTTGTTTATGCAAGCATGTCACCTATAGTGCACATTGTTGATGTT
GGTTCTGGGACAATGGAGTCTCTTGCAAATGTTACGGAGATACATGATGGATTGGACTTTTCTGCT
GCAGNCTCTCAGAATTTTGGCACACACGTCTGATGTTAACACTGTATGTTTTGGTGATGAAAGTGG
CCATCTAATCTATTCTGGGAGTGATGACAATCTATGCAAGGTATGGGATAGACGCTGTCTAAATGT FIGURE 26 (continued)

```
GAAAGGGAAGCCAGCAGGAGTCCTGATGGGACACCTAGAAGGGATCACGTTCATTGATAGCCGTGG
AGATGGTCGTTATCTGATCTCAAATGGTAAAGATCAGGCCATCAAACTTTGGGATATTCGGAAAAT
GTCCTCTAATGCATCCTGCAATTTAGGATTTAGGAGTTATGAATGGGATTACAGATGGATGGACTA
CCCACCCCAGGCAAGAGATTTGAAACACCCATGTGATCAATCCGTTGCTACGTATAAAGGTCATTC
TGTCTTGCGTACTCTTATCCGGTGCCACTTTTCCCCTGTATACAGCACTGGCCAAAAGTATATCTA
CACTGGATCCCATGATTCTTGTGTTTATGTTTATGACCTGGTGAGTGGTGAGCAAGTTGCTGCACT
CAAGTACCATACTTCACCCGTTAGAGACTGTAGTTGGCACCCAAGTCAACCAATGCTTGTTAGCTC
TTCTTGGGATGGAGATGTTGTCAGGTGGGAGTTTCCGGGTAATGGAGAAGCTGCTCCTCCTCTAAA
CAAGAAGAGGATCCGGAGGAGACAGTTTTACTTGTGA
```

N can be a stretch of 105 to 135 nucleotides

SEQ ID NO: 258 Citrus sinensis Citsi_WDR23-like partial translated polypeptide sequence
```
MFVTASGVDFDEMGYAMSRFEIESEFYDAADTVNQASNSRSKFKKPLSALDHEIAQLTKLKSEPKE
HFSKEVPGKRHLPVSTVKMLAGREGNYSGRGRFSAADCCHMLSRYLPVNGPWPVDQTTSRAYVSQF
SADGSLFVAGFQASQIRIYDVERGWKIQKDILAKSLRWTVTDTSLSPDQRHLVYASMSPIVHIVDV
GSGTMESLANVTEIHDGLDFSAAXLRILAHTSDVNTVCFGDESGHLIYSGSDDNLCKVWDRRCLNV
KGKPAGVLMGHLEGITFIDSRGDGRYLISNGKDQAIKLWDIRKMSSNASCNLGFRSYEWDYRWMDY
PPQARDLKHPCDQSVATYKGHSVLRTLIRCHFSPVYSTGQKYIYTGSHDSCVYVYDLVSGEQVAAL
KYHTSPVRDCSWHPSQPMLVSSSWDGDVVRWEFPGNGEAAPPLNKKRIRRRQFYL
```

X can be a stretch of 35 to 45 amino acids

SEQ ID NO: 259 Glycine max Glyma_WDR23-like II partial nucleic acid sequence
```
ATGTCTAGTAGGGCTTATGTCTCCCAGTTTTCAGCTGATGGCTCTCTTTTTATTGCTGGGTTCCAG
GGAAGTCACATAAGAATATACAACGTGGACAGAGGTTGGAAAGTTCAGAAGAACATTCTAGCTAAA
AATTTGAGATGGACAATCACTGATACATCTCTTTCACCTGATCAACGCTATCTAGTTTATGCCAGT
ATGTCACCTATTGTACACATTGTAAATGCCGGATCTGCTGAAACGGAGTCCCTAGCAAATGTTACA
GAGATACATGATGGTTTGGATTTTTCATCAAATGATGATGGAGGATACTCCTTTGGAATTTTCTGT
GTGAAATTCTCAAAAGATGGGAAGAATTAGTTGCAGGAAGTAGTGGTGATTCTATATATGTATAC
GATCTTGAAGCAAATAAGCTCTCACTTCGAATTTTAGCTCACACGTGTGATGTGAACACTGTATGT
TTTGCTGATGAAACTAGCCATCTTATTTACTCTGGGAGTGATGATAGTTTCTGCAAGGTCTGGGAT
CGGCGTTGCTTGATTGCTAAAGGCAAGCCAGCAGGGGTTTTAATGGGACACCTTGAGGGCATTACA
TTTATTGATACTCGAGGAGATGGACGCTATTTCATTTCAAATGGTAAAGATCAAACCATTAAACTT
TGGGACATACGCAAAATGTCATCCAATGTTACCAGCAATCCTGGGTATAGGAGTTACGAATGGGAT
TACAGGTGGATGGATTATCCACCCCAAGCAAAAGACTTGACTCACCCTTGTGATCAGTCAGTGGCT
ACTTATAGAGGCCATTCGGTCTTACGCACTCTCATCCGCTGCTATTTCTCCCCAGCGTTTAGCACG
GGCCAGAAGTACATCTATACTGGATCACACAACGCATGTGTTTATATATATGATTTGGTAAGTGGA
GCTCAAGTCGCAACGCTGAAGCACCATAAATCACCTGTAAGAGATTGTAGCTGGCACCCCTTCCAC
ACTACACTTGTTAGCTCTTCTTGGGATGGAGATGTTGTGAAATGGGAATTTGCTGGGAGTGGTGAT
ACACCAGGCTCTTCAACTAAGAAGAGGGTATGGACAAGACATTTTTATGAACATTACCTATGA
```

SEQ ID NO: 260 Glycine max Glyma_WDR23-like II partial translated polypeptide sequence
```
MSSRAYVSQFSADGSLFIAGFQGSHIRIYNVDRGWKVQKNILAKNLRWTITDTSLSPDQRYLVYAS
MSPIVHIVNAGSAETESLANVTEIHDGLDFSSNDDGGYSFGIFCVKFSKDGKELVAGSSGDSIYVY
DLEANKLSLRILAHTCDVNTVCFADETSHLIYSGSDDSFCKVWDRRCLIAKGKPAGVLMGHLEGIT
```

FIGURE 26 (continued)

FIDTRGDGRYFISNGKDQTIKLWDIRKMSSNVTSNPGYRSYEWDYRWMDYPPQAKDLTHPCDQSVA
TYRGHSVLRTLIRCYFSPAFSTGQKYIYTGSHNACVYIYDLVSGAQVATLKHHKSPVRDCSWHPFH
TTLVSSSWDGDVVKWEFAGSGDTPGSSTKKRVWTRHFYEHYL

SEQ ID NO: 261 Hordeum vulgare Horvu_WDR23-like I partial nucleic acid sequence
ATGGGTTATGGCATGAGTAGGCTGCATGAGGGATACAGTGAACATGAAGGGCAGAATAGTGATGGA
TCTAGTTCAGTCGAAGTGAATAATGACTTCTCAAAATTAAATAATGATATTTTCCACATGACTCGA
CTAAGATCAGGACCTAGTGAAAGCATCCGCAAGTCCATGGATAGAGTCTCAGTAACTAGGTTGTTA
CGTGGAAGGGAAGTTAACTCTTCAGGAAATGGAAAGTTTTCTCCGGTTGATCGTGCATTCGTTCTT
GGTCATTATCTTCCAGTGGATGGTCCTGAAACAGTGGACAGGATGGATTCACGAGCTTATGTTTCA
CATTTTTCTGCCGATGGTTCTCTTTTTGTTGCTGGTTTTCAGGGAAGCCACATAAGAATATATGAT
GTCGATAAAGGCTGGGAAGTACACAAGGATATTCATGCTAGAAGTTTGAGAT SEQ ID NO: 262 Hordeum vulgare Horvu_WDR23-like I partial translated polypeptide sequence
MGYGMSRLHEGYSEHEGQNSDGSSSVEVNNDFSKLNNDIFHMTRLRSGPSESIRKSMDRVSVTRLL
RGREVNSSGNGKFSPVDRAFVLGHYLPVDGPETVDRMDSRAYVSHFSADGSLFVAGFQGSHIRIYD
VDKGWEVHKDIHARSLR SEQ ID NO: 263 Hordeum vulgare Horvu_WDR23-like III partial nucleic acid sequence
AACTCGTGCATGCCTTCATGCTGGCAAGAGCCATATCTCTACATTCAAGCTGTTGTCATCAAGAGA
ATCCAATCGCTCCGGATTTGGTAGATTCTCTTCAGCCGATTGCTCTTATGCTCTTCGCAAACACCT
ACCAGTAAGAGGCCCGTGGTGTGTTGATAGCATGGATTGCGCAGCATACATCTCACAATTCTCTTT
GGATGGTTCTCTACTAATTGGGAGGCGTATCAGAATCTATAACGCTGACAAAAATGGAAGATCCA
CAAGGATATAACCTGCAAAAGTCTGCGGTGGACAGTATCAGATATTGCTCTCTCACCTGATCAACA
ATACCTAGCATATTCCAGTCTGTCCCCTACTGTTCACATAGTAAATGTTCAGAATGCTCCGAAGCA
GTCACATGCTAATATTACAATGCAGGATGTTCATGAGGGTTTGAATTTTCTGCTGCTGCTGATGA
ATCCTCCTTTGGAATATTTTCAATAAAGTTTTCAAAAGATGGGCATGAACTTGTTGTTGGAAACAG
CAATGAGTCAATATGTATTTATGATCTTGGAGCAAACAAAGTGACAGAGCGAATTCATGCTCATGT
GGCTGATGTTAATGCGGTCACGTTCGCTGATGAATCTGGTGGTGTCTTGTACTCCGGAAGTGATGA
TAGCCTCTGTAAGGTGTGGGATAGGCGTTGCCACAACAGAGCGAAACCAGTAGGTGTTTTGGCAGG
TCATTTAGATGGAGTTACATTTATTGATAGCCATGGAGACGGGCATTATTTCATCTCCAACTGCAA
GGATCAGACTATTAAACTATGGGATATCAGAAAATTGTCCTCGGCTACGAAGGACTGCACACCAAA
AGCATACGAATGGGATTACAGATGGATGACCTATCCATCAGAAGCCCGATTTTTGAAGCATCCATA
TGATCAATCGCTAGCCACATTCAGAGGCCATTCGGTGTTGCGCACACTTATCCGTTGCTACTTTTC
CCCAATGCACAGCACAGGTCAGAGGTATATATACACAGG SEQ ID NO: 264 Hordeum vulgare Horvu_WDR23-like III partial translated polypeptide sequence
TRACLHAGKSHISTFKLLSSRESNRSGFGRFSSADCSYALRKHLPVRGPWCVDSMDCAAYISQFSL
DGSLLIGRRIRIYNADKKWKIHKDITCKSLRWTVSDIALSPDQQYLAYSSLSPTVHIVNVQNAPKQ
SHANITMQDVHEGLNFSAAADESSFGIFSIKFSKDGHELVVGNSNESICIYDLGANKVTERIHAHV
ADVNAVTFADESGGVLYSGSDDSLCKVWDRRCHNRAKPVGVLAGHLDGVTFIDSHGDGHYFISNCK
DQTIKLWDIRKLSSATKDCTPKAYEWDYRWMTYPSEARFLKHPYDQSLATFRGHSVLRTLIRCYFS
PMHSTGQRYIYT

FIGURE 26 (continued)

SEQ ID NO: 265 Pinus taeda Pinta_WDR23-like partial nucleic acid sequence
ATGGGAAACTCACAGTTTCAAAATCATCATTTTGACAAAGATGATAACAGTAACAGAAATGATGAA
GTCCAAAATATGGATGATGCTTCTGAAGATCCCAACAAACTTCACCATGAACTTGAACATATAACA
AAGCTGAGGTCAGCACCAAATGGTATGCTGTCCAGGATGAATGGTAAGAGCCAGAATGGCTATGTT
TCAACATTATCTATGTTGGCAGGCAGAGAAGCCAATATTTCTGGGAGAGGGAAATTTAGTGTAGCT
GATTGCTGTCATGTTGCAAGTAGATATTTGCCATCTTGTGGCCCAGATATAATGGATATGATGGAC
AGTAGAGCATATATTGGACAATTTTCAGCAGATGGCTCCCTTTTTGTCACAGGATTTCAGGATCAT
CGGATAAGAATATACAATGTGGAGAATGGATGGACAATTCAAAAGGATGTGCTTGCTAGAAACTTG
CGTTGGACTATCACTGACACTTCTCTTTCACCTGATCAGCGTTACCTTGTGTATGCTACTATCACT
CCTATTGTCCACATTGTGAATGTTGGAAGCAGTGTCAGAGAATCCTTAGCAAACGTCACANCATTA
CTTTCATCGATAGTCGTGGAGATGGACGCTATTTTATTTCTAATGGAAAAGACCAGACGACAAAGA
TGTGGGATATTCGCAAAATGACTGCAGGAAATCCTAGCATAAAGTCAAGGAGTTCCTCTGGTAATG
AATGGGATTATCGTTGGATGGAGTATCCAAAGAATAGGAAGAATGCTAAGCATCCATATGACCAGT
CTCTGATGACTTACAGGGGACATGCTGTCTTGCGTACTCTTGTCCGCTGCTACTTCTCTCCATCCT
TCAGCACTGGCCAGAAATACATCTACACAGGATCACACGATGGCTGTGTTTATATTTATGATGTGG
TAAGTGGGAACCTCATTAAGAAACTCGACTATCATAGGTCCACTGTGAGGGACTGCAGCTGGCATC
CGTTCTATCCAACTCTTGTAAGCTGTTCATGGGATGGAGTTGTTGCCAAATGGGACCATTCAACAG
CAAGAAGTCGCAGAAGCCGCAGCCCGTGA N can be a stretch of 315 to 330 nucleotides

SEQ ID NO: 266 Pinus taeda Pinta_WDR23-like partial translated polypeptide sequence
MGNSQFQNHHFDKDDNSNRNDEVQNMDDASEDPNKLHHELEHITKLRSAPNGMLSRMNGKSQNGYV
STLSMLAGREANISGRGKFSVADCCHVASRYLPSCGPDIMDMMDSRAYIGQFSADGSLFVTGFQDH
RIRIYNVENGWTIQKDVLARNLRWTITDTSLSPDQRYLVYATITPIVHIVNVGSSVRESLANVTXI
TFIDSRGDGRYFISNGKDQTTKMWDIRKMTAGNPSIKSRSSSGNEWDYRWMEYPKNRKNAKHPYDQ
SLMTYRGHAVLRTLVRCYFSPSFSTGQKYIYTGSHDGCVYIYDVVSGNLIKKLDYHRSTVRDCSWH
PFYPTLVSCSWDGVVAKWDHSTARSRRSRSP X can be a stretch of 315 to 330 amino acids

SEQ ID NO: 267 Saccharum officinarum Sacof WDR23-like partial nucleic acid sequence
ATGGGTTATGGCATGAGTAGGCTAGAAGATGAATATTATGAGCCTGAAGGGCAGAATACTGATGGA
TCTGGCTCAGTTCAAGTGAACGATGAGTTTGCAAAACTGCACAACGATATTTTCATATGACACGA
ATGAGATCAAGACTTACTGAAAGGTACAAGTCCATGGATACCAACAGAGGCATAATATCAACGGCC
AAGTTATTATCTCGAAGGGAAATTGATTGTTCTGGAAAGGGGATGTTCTCTTCTTGTGACCGTGCA
TTTGTTCTAGGTCGCTATGTTCCAATGAATGGCCCTGAATTATTGGATAGGATGGATTCTCGTGCT
TATGTTTCACAGTTTTCTGCTGATGGTACTCTTTTGGTGCTGGTTTTCAGGGAAGTCACATAAGA
ATATATGATGCTGATAGAGGCTGGAGCATACACAAAGACATTCATGCTAAGTGTTTGAGATGGACA
ATCAGTGATGTATTCCTATCACCTGATCAACGGTATCTTGCCTACTCTAGTCTGGCACCTATTAAT
CATATTGGCAATGTCGGAAATGCTGGAAGAGAATCCTNGTCGACCCACGCGTCCGGCCGGCAGCAA
TGATGAATCAATATATGTCTATGACCTTCAAGCAAACAAATTGACATTACGTTTACCTGCTCATAC
ATCTGATGTCAATACAGTAGCATTTGCTGATGAAACCGGCCATCTCATATATTCAGGAAGTGACGA
CACTTTATGCAAGGTCTGGGACAGGCGGTGTTTGTCCACAGGACAAGCTGCCGGAGTTTTGACTGG
ACATTTGCATGGGGTAACACACATTGATAGTCGTGGAGATGGCCGAAGTTTCATATCCAATGGAAA FIGURE 26 (continued)

```
AGACCAAGCAATCAAACTGTGGGATGTCAGGAAAATGACGTCCAATGCTGATAGTTGTGCAGACGG
AGCCCCAACTTGGGACTACAGATATTCAAGGTATCCGCAGCAGCATAAACAGTTAAAGCATCCGCA
TGATCAGTCATTAGCGACATACCGTGGACATTCAGTCCTCCGGACATTGATCCGTTGCTACTTTTC
TCCTGCTTACAGCACTGGGCAAAAGTACATATATACAGGGTCGTATGATTCCTGCGTTACATCTA
TGATGTGGTAAGTGGATCGCAAGTTGCGAAGCTGAAATGGCATCAAATGGCGATACGTGACTGCAG
CTGGCACCCATTTGAGCCCACGCTTGTGAGCTCATCCTGGGACGGCCATGTAGCGAAATGGACCAG
TGCACGTGATCAAAA
```

N can be a stretch of 90 to 120 nucleotides

SEQ ID NO: 268 Saccharum officinarum Sacof WDR23-like partial translated polypeptide sequence
```
MGYGMSRLEDEYYEPEGQNTDGSGSVQVNDEFAKLHNDIFHMTRMRSRLTERYKSMDTNRGIISTA
KLLSRREIDCSGKGMFSSCDRAFVLGRYVPMNGPELLDRMDSRAYVSQFSADGTLFGAGFQGSHIR
IYDADRGWSIHKDIHAKCLRWTISDVFLSPDQRYLAYSSLAPINHIGNVGNAGRESXRPTRPAGSN
DESIYVYDLQANKLTLRLPAHTSDVNTVAFADETGHLIYSGSDDTLCKVWDRRCLSTGQAAGVLTG
HLHGVTHIDSRGDGRSFISNGKDQAIKLWDVRKMTSNADSCADGAPTWDYRYSRYPQQHKQLKHPH
DQSLATYRGHSVLRTLIRCYFSPAYSTGQKYIYTGSYDSCVHIYDVVSGSQVAKLKWHQMAIRDCS
WHPFEPTLVSSSWDGHVAKWTSARDQ
```

X can be a stretch of 30 to 40 amino acids

SEQ ID NO: 269 Sorghum bicolor Sorbi WDR23-like partial nucleic acid sequence
```
ATGGGTTATGGCATGAGTAGGCTAGAAGATGAATACTATGAGCCTGAAGGGCAGAATACTGATGGA
TCTGGCTCAGTTCAAGTGAACAATGAGTTTGCAGAACTGCATAACGATATTTTTCATATGACCCGA
ATGAGATCAAGACTTACTGAAAGCTACAAGTCCATGGGTACCAACAGAGGCATAATATCAACGGCC
AAGTTATTATCTCAAAGGGAAATTGATTGTTCTGGAAAGAAGATGTTCTCTTCTGGTGACCGTGCA
TTTGTTCTAGGTCGCTATGTTCCAATGAACGGCCCTCAGTTATTGGATAGGATGGATTCTCGTGCT
TATGTTTCGCAGTTTTCTGCTGATGGCACTCTTTTTGTTGCTGGTTTTCAGGGAAGTCACATAAGA
ATATATGATGCTGATAGAGGCTGGAGCATACACAAAGACATTCATGCTAGGTGGTTGAGATGGACA
ATCAGTGATGTATCCTTATCACCTGATCAGCGGTATCTTGCCTACTCTAGTCTGGCACCTATTGTN
CGTTTACCTGCTCATACATCTGATGTCAATACAGTAGCATTTGCTGATGAAACTGGCCATCTCATA
TATTCTGGAAGTGACGACACTTTATGCAAGGTCTGGGACAGGCGGTGTTTGTCCACAGGACAAGCT
GCCGGAGTTCTGACTGGACATTTGCATGGGGTAACACATATTGATAGTCGTGGAGATGGCCGAAGT
TTCATATCGAATGGAAAAGACCAAGCAATCAAACTGTGGGATGTCAGGAAAATGACGTCCAATGCT
GATAGTTGTGCAGACGGAGCCCCAAGTTGGGACTACAGATATTCGAGGTATCCGCAGCAGCATAAA
CAGTTAAAGCATCCGCATGATCAGTCATTAGCGACATACCGTGGACATGCAGTCCTCCGGACATTG
ATCCGTTGCTACTTTTCTCCTGCTTACAGCACTGGGCAAAAGTACATATATACAGGGTCGTATGAT
TCCTGCGTTTACATCTATGATGTGGTAAGTGGATCGCAAGTTGCGAAGCTGAAATGGCATCAAATG
GCGATTCGTGACTGCAGTTGGCACCCATTTGAGCCCACGCTTGTGAGCTCATCCTGGGACGGCCAG
GTAGCAAAATGGACCAGTGCACGTGATCAACAGGCTTCTGATATAGATTGA
```

N can be a stretch of 135 to 165 nucleotides

FIGURE 26 (continued)

SEQ ID NO: 270 Sorghum bicolor Sorbi WDR23-like partial translated polypeptide sequence
MGYGMSRLEDEYYEPEGQNTDGSGSVQVNNEFAELHNDIFHMTRMRSRLTESYKSMGTNRGIISTA
KLLSQREIDCSGKKMFSSGDRAFVLGRYVPMNGPQLLDRMDSRAYVSQFSADGTLFVAGFQGSHIR
IYDADRGWSIHKDIHARWLRWTISDVSLSPDQRYLAYSSLAPIVXRLPAHTSDVNTVAFADETGHL
IYSGSDDTLCKVWDRRCLSTGQAAGVLTGHLHGVTHIDSRGDGRSFISNGKDQAIKLWDVRKMTSN
ADSCADGAPSWDYRYSRYPQQHKQLKHPHDQSLATYRGHAVLRTLIRCYFSPAYSTGQKYIYTGSY
DSCVYIYDVVSGSQVAKLKWHQMAIRDCSWHPFEPTLVSSSWDGQVAKWTSARDQQASDID X can be a stretch of 45 to 55 amino acids

SEQ ID NO: 271 Conserved Domain comprised in SEQ ID NO: 2
YVSQFSTDGSLFIAGFQGSRIRIYNVEKGWKVQKDILAKSLRWTVTDTSLSPDQRNLVYASMSPIV
HIVDVGSGSTESHANVTEIHDGLDFSSDEDGGYSFGIFSVKFSTDGREVVAGSSDDSIYVYDLEAN
RVSLRTVAHTSDVNTVCFADESGNLILSGSDDNLCKVWDRRCFIGRDKPAGVLVGHLEGVTFIDSR
GDGRYFISNGKDQTIKLWDIRKMSSSAPARHEVLRNYEWDYRWMDYPTEARDLKHPLDQSVSTYKG
HSVLRTLIRCYFSPAHSTGQKYIYTGSNDSSVYIYDLVSGDKVAVLKHHSSPVRDCNWHPYYPTLI
SSSWDG

SEQ ID NO: 272 Oryza sativa GOS2 promoter
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA FIGURE 26 (continued)

```
AGAACTTATCCGATTTCTGATCTCCATTTTTAATTATATGAAATGAACTGTAGCATAAGCAGTATT
CATTTGGATTATTTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC
```

SEQ ID NO: 273 Orysa sativa MT promoter
```
CTTGTTGTTGATCTGTGCCCCAAGAAGAATAACACTCTACTCTTACTTGTTGGAAAAAAATAGTA
TTAGCAACCACGCATATGCAAATTTTAATGCAGTAATAATAAGAGATGGATCGATCGTTTTCCAGC
TCTTGTATATGTGACTGGCCCTGCTTTATGTGTGTAGTGTTAATTTCAGCTTTAGCAGTACGTGAT
TAGTGATGGACAATAATTGTCGCAGACGTATCTATCAATTGCTCCTGTTGTGTGATGCTTTAACTG
TTGGAATCAAAGTTGCGTTGCCTTTGTTGTTATGAGGAGGAATATATATGTTGGGCAGGAAAAGA
ATGGAGGAGAGATCGTTCTCCATATCCTTATCATCGGCCTCGTCACTGCTCGCAGTTTAACTTTTT
GGTGATGCGAGCGATGGTCAGCCATATATATACTCCCATGCTGCATGCTAGTAATCAATATACGCC
TTGTAAAAGTAAACGATCGTCTAGTAATTGCAATATCATAGGGGTAGCCATTGACAGAGATCTACA
TAGATAGAGGGGAACAAGAATTGACACTCCACAGATGCTCCACTCATTCACCTTTACTAATTTAT
ATCTTTTGATGTTTGATCGATCGATCGATCCGTCCGTCGGTGTCTCGACGAATAAAAACTGCAAAT
CGAACTGTATGTATATAATATAGCGTCGTAAATTAAATTAAATTAAATCGAACTGAATACTACATG
TCGAAGCAAGAATTAGTTCAACTAAAAGATTTAGTTTTTCCGGTTGCAATATCTGTGAAATTAATT
GAAGAAATTAAGAAGAAAACTGGAGAGATATATATATGGATGAGACAAAATGAGATAAGACGCATG
ATGGTCCCTCGGATGATGTCGTCCGTTCCTTATTTCCATTCCATGGCAGCTGCTATCGCTATCTAG
TGCGCGCGGCATCTCCAATCCCATCCATTCTAGTGGTCGATCTAGCTACTACTGAGTATTGTTTTT
TCTTCTTTTTACTACTGTTGATTATTCTGCAACTGCAGTTAGATGCTTGCTACTCCTACATCGATC
TCTCTCGCGCGGGCGTATGCATTGCATTCACTACTGATGATCCGTGGGTGTAGTGTGGGTGGCTAT
AAATAGGGCAGGGTGCGGTTGCCATTGCTCCTCAGGCCAGCAACTGAGAAGCTCCATACAAGTAAG
CAGCAGCTAGTTGCCGACAAGGCCAGAGAAGGAAGAAGAAGCTCTCATCATCATCAC
```

SEQ ID NO: 274 primer prm09100
```
GGGGACAAGTTTGTACAAAAAAGCAGGCTTAAACAATGTTTTTTGGACCAAGTGAG
```

SEQ ID NO: 275 primer prm09101
```
GGGGACCACTTTGTACAAGAAAGCTGGGTTGTGTAGAGAGACGCATCAGT
```

FIGURE 26 (continued)

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2008/066237, filed Nov. 26, 2008, which claims benefit of European application 07121546.1, filed Nov. 26, 2007, European Application 07121565.1, filed Nov. 26, 2007, European Application 07122488.5, filed Dec. 6, 2007, European Application 07122911.6, filed Dec. 11, 2007, European Application 07122998.3, filed Dec. 12, 2007, U.S. Provisional Application 61/013,649, filed Dec. 14, 2007, U.S. Provisional Application 61/013,648, filed Dec. 14, 2007, U.S. Provisional Application 61/014,619, filed Dec. 18, 2007, U.S. Provisional Application 61/014,757 filed, Dec. 19, 2007, U.S. Provisional Application 61/027,053, filed Feb. 8, 2008, European Application 08166636.4, filed on Oct. 15, 2008, and U.S. Provisional Application 61/106,989, filed Oct. 21, 2008.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Second_Revised_Sequence_List_13311_00068_US. The size of the text file is 703 KB, and the text file was created on Sep. 13, 2012.

The present invention relates generally to the field of molecular biology and concerns a method for enhancing yield related traits by modulating expression in a plant of a nucleic acid encoding a PATL (PATELLIN) polypeptide, or a PRP38 (Precursor RNA Processing factor 38), or a GATA-like polypeptide, or an ADA2 (Transcriptional Adaptor 2) polypeptide, or a WDR23-like polypeptide. The present invention also concerns plants having modulated expression of a nucleic acid encoding a PATL polypeptide, or PRP38, or a GATA-like, or an ADA2 polypeptide, or a WDR23-like which plants have enhanced yield-related traits relative to corresponding wild type plants or other control plants. The invention also provides hitherto unknown PATL, or PRP38, or GATA-like, or ADA2, or WDR23-like nucleic acids and constructs useful in the methods of the invention.

In one embodiment, the present invention also concerns a method for improving plant growth characteristics by modulating expression in a plant of a nucleic acid encoding a GATA-like polypeptide. The present invention also concerns plants having modulated expression of a nucleic acid encoding a GATA-like polypeptide, which plants have improved growth characteristics relative to corresponding wild type plants or other control plants. The invention also provides constructs useful in the methods of the invention.

In another embodiment, the present invention concerns a method for increasing various plant yield-related traits by increasing expression in a plant of a nucleic acid sequence encoding a WD40 repeat (WDR) 23-like polypeptide. The present invention also concerns plants having increased expression of a nucleic acid sequence encoding a WDR23-like polypeptide, which plants have increased yield-related traits relative to control plants. The invention additionally relates to specific nucleic acid sequences encoding the aforementioned polypeptides having the aforementioned plant yield increasing activity, nucleic acid constructs, vectors and plants containing said nucleic acid sequences.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (Zea mays L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

Another trait of importance is that of improved abiotic stress tolerance. Abiotic stress is a primary cause of crop loss worldwide, reducing average yields for most major crop plants by more than 50% (Wang et al. (2003) Planta 218: 1-14). Abiotic stresses may be caused by drought, salinity, extremes of temperature, chemical toxicity, excess or deficiency of nutrients (macroelements and/or microelements), radiation and oxidative stress. The ability to increase plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield-related traits (seed yield and/or biomass) in plants may be through modification of the inherent growth mechanisms of a plant, such as the cell cycle or various signalling pathways involved in plant growth or in defence mechanisms.

It has now been found that various yield-related traits may be enhanced in plants by modulating expression in a plant of a nucleic acid encoding a PATL (Patellin) polypeptide, or a PRP38 (Precursor RNA Processing factor 38), or an ADA2 (Transcriptional Adaptor 2) polypeptide, or a WD40 repeat (WDR) 23-like polypeptide.

It has furthermore been found that various growth characteristics may be improved in plants by modulating expression in a plant of a nucleic acid encoding a GATA-like (Protein Of Interest) in a plant.

The increased yield-related traits comprise one or more of: increased total seed yield per plant, increased seed filling rate, increased number of filled seeds, increased harvest index, or increased thousand kernel weight.

Lipids are substances soluble in non-polar solvents, such as chloroform or ether. Lipids are essential components in living organisms. Lipid such as glycolipids, phospholipids, and cholesterol are key structural components of cell membranes, and triglycerides are the biological energy-source molecules. Phosphatidylinositide (PtdIns) and Phosphatidylcholine (PtdCho) are examples of phospholipids. Interactions between lipids and proteins function in targeting proteins and glycolipids involved in a variety of processes, such as cell signaling and cell proliferation, to specific membrane and intracellular locations. Various proteins are associated with the biosynthesis, transport, and uptake of lipids. In addition, key proteins involved in signal transduction and protein targeting have lipid-derived groups added to them post-translationally (Stryer, L. (1995) Biochemistry, W.H. Freeman and Co., New York N.Y., pp. 264-267, 934).

Phosphatidylinositol/phosphatidylcholine transfer proteins (PIPTs) are ubiquitous proteins involved in coordinate regulation of PtdIns and PtdCho metabolism by facilitating the transfer among the different membrane compartments of eukatyotic cells. In yeast, the major PIPT is the SEC14 protein which is essential for secretion from the trans-Golgi network (Bankatis et al. 1989, J. Cell Biol. 108:1271-81). Similar proteins are found in plants and other higher organisms. In plants, several SEC14 homologs have been described to have around 25% amino acid sequence similarity to the yeast S. cerevisiae SEC14 protein and in some instances the putative PtdIns/PtdCho transfer function has been experimentally verified by complementation of the sec14-1 temperature-sensitive yeast mutant (Jouannic et al. 1998). Plant SEC14 proteins reportedly play a role in diverse biological processes such as cytokinesis, hyperosmosis stress-induced signalling pathway, vesicle trafficking between various membranes or membrane biogenesis during nodulation (Allen-Baume et al. 2002; FEbs Letters 531: 74-80; Peterman et al. 2004. Plant Phys. 136: 3080-3094; Monks et al. 2001, Plant Cell 13:1205-19; Kapranov et al. 2001 Plant Cell 13:1369-1382).

In *Arabidopsis thaliana* the Patellin1 (PATL1) protein, a member of the SEC14 homolog protein family, has been reported to localize to the cell plate during cytokinesis and shown to have PtdIns binding activiy. PATL1 is a member of a small family of six proteins in *Arabidopsis* characterized by the presence of two conserved domains, a SEC14 and a GOLD (Golgi dynamics) domain.

The SEC14 domain is found in the SEC14 protein of yeast and in in RhoGAPs, RhoGEFs and the RasGAP, neurofibromin (NF1). It is also found in C-terminal of various retinaldehyde/retinal-binding proteins (CRAL-BP) that may be functional components of the visual cycle and in the Trio protein, a multifunctional factor that integrates and amplifies signals involved in actin remodelling. SEC14 is sometimes refer to as CRAL_TRIO domain. SEC14 domain is involved in lipid binding (Sha and Luo. 1999. Biochim Biophys Acta. 1441: 268-77).

The GOLD domain is a protein module found in several eukaryotic Golgi and lipid-traffic proteins. It is typically between 90 and 150 amino acids long. Most of the size difference observed in the GOLD-domain superfamily is traceable to a single large low-complexity insert that is seen in some versions of the domain. GOLD domains occur in proteins that may interact with membranes or which may have a role in the interaction of various proteins with cytoskeletal filaments such as animal SEC14 proteins or the yeast oxysterol-binding protein homolog 3 (OSH3). The GOLD domain is predicted to mediate diverse protein-protein interactions (Anantharaman et al. 2002. Genome Biol. 3).

The patent application WO 2004/090141 describes a partial PATL protein involved in stress tolerance.

The synthesis and function of messenger RNA (mRNA) in a cell requires a series of events including transcription, processing, transport, translation and degradation. RNA processing refers to events modifying RNA posttranscriptionally. In eukaryotic organisms the majority of the nascent pre-mRNA contains introns, which are spliced out resulting in the precise ligation of exons to produce a mature mRNA, which is the RNA form used by the ribosomes to translate into a protein. Posttranscriptional modification of RNAs also includes capping at the 5' end and polyadenylation at the 3' end, which affects stability and the efficiency of translation. The relationship between mRNA translation and turnover is critical to the regulation of gene expression and to the correct functioning of the cell. In eukaryotic organisms, several tens of proteins are involved in RNA metabolism. An example of such a protein is the pre-mRNA splicing factor PRP38.

Yeast PRP38 was identified in a genetic screen of temperature-sensitive mutants of Saccharomyces cerevisiae defective in pre-mRNA splicing (Blanton et al. 1992, Mol. Cel. Biol. 12, 3939-3947). The excision of intervening sequences from eukaryotic pre-mRNA transcripts occurs in the nucleus on a large, complex structure termed the spliceosome. The spliceosome directs intron removal by a two-step mechanism comprising (i) cleavage at the 5' splice site and ligation of the 5'-terminal nucleotide of the intron to an adenosine near the 3' end on the intron and (ii) cleavage at the 3' splice site and exon ligation. Assembly of the spliceosome progresses by the sequential addition of the U1, U2. U4/U6 and U5 snRNPs (Small Ribonuclear Proteins U1-U6). Late in the assembly process the U4 disassociates from the spliceosome. The catalytic events of splicing leading to intron removal in pre-mRNA molecules are believed to occur subsequent to U4 dissociation. In yeast, PRP38 is reportedly dispensable for spliceosome assembly but required for conformational changes which lead to catalytic activation of the spliceosome (Xie et al. (1998) EMBO Journal Vol. 17 pp. 2938-2946).

In *Arabidopsis thaliana*, PRP38 protein (AtPRP38) was named SRL1 (SR like 1), after its sequence similarity with SR proteins (Forment et al. Plant J. 2002 June; 30(5):511-9. However PRP38 is structurally distinct from other SR proteins. Typically SR proteins comprise an RRM domain (RNA binding domain) and an RS domain (Kalyna and Barta Biochem Soc Trans. 2004 32:561-4), while AtPRP38 comprises the RS domain, but lacks the RRM domain.

WO 01/81599 describes methods to improve stress tolerance in yeast and plants using nucleic acids encoding several SR proteins. SRL1 as well as other proteins functioning in pre-mRNA splicing have been found to play an important role in plant responses to abiotic stresses (Lee et al. 2006 Plant Cell. July; 18(7):1736-49).

The GATA family forms one of the major families in Cys2/Cys2-type zinc finger transcription factor in eukaryotes (found e.g. in cellular slime mold, plants, fungi, nematodes, insects, echinoderms, vertebrates) and contain either 1 or 2 highly conserved zinc finger DNA binding domains. The DNA-binding consensus is $CX_2CX_{17-20}CX_2C$ and contains the zinc atom coordinated by the conserved 4 cysteines (Omichinski et al., 1993; Reyes et al., 2004). This domain is typically followed by a basic region. It characteristically binds DNA at the GATA recognition sequence (A/T)GATA (A/G) (Martin and Orkin, 1990; Omichinski et al., 2003). Animal GATAs typically contain 17 residues between second and third cystein, whereas in fungi this can be 17-18 (rarely 19 or 20). Plants have 18 or 20 residues between the second and third cystein.

The original GATA1 was identified as a transcription factor required to promote the expression of globin genes in humans (Pevny et al., 1991). The first plant GATA (NTL1) was isolated form tobacco as a plant homologue of the Neurospora crassa transcription factor NIT2, a protein that activates the expression of the genes for nitrogen-metabolic enzymes during nitrogen-limiting conditions. NTL1 contains 18 spacings between the second and the third cysteine ($CX_2CX_{18}CX_2C$) (Daniel-Vedele and Caboche, 1997). The genomes of *Arabidopsis thaliana* and *Oryza sativa* present 29 and 28 loci respectively that encode for putative GATA transcription factors ($CX_2CX_{18or20}CX_2C$) (Reyes et al., 2004): *Arabidopsis* only has proteins with one GATA domain, while *Oryza sativa* has two proteins containing two and one protein containing three GATA domains. The rice transcription factors database (DRTF, Gao et al. Bioinformatics 2006, 22, 1286-1287) claim 28 GATAs in Indica and 23 in Japonica. The GATA family of transcription factors in rice and *Arabidopsis* can be divided into 7 subfamilies, some of these represented in both species but others are exclusive for one of them.

Ectopic expression of a GATA-like protein (HAN) under control of the strong constitutive 35S promoter seriously affected plant viability and development (Zhao et al. Plant Cell 16, 2586-2600, 2004). The transformed plants were dwarfed with abnormally formed leaves and smaller and malformed inflorescences. US2007/0250956 discloses OsGATA11 and its use for increasing seed yield.

The regulation of transcription in plants underlies many biological processes such as adaptation to environment and regulation of metabolic and physiological balances. Therefore altering gene transcription in a plant may result in profound modifications of plant growth and development. This property may be used to improve performance of crop plants. There are hundreds of genes controlling gene expression and only a few of them have been shown to have a beneficial effect on traits of interest to agriculture industry, when its expression is modulated in the plan (Vinocur and Altman, 2005, Current Opinion in Biotechnology 16,123-132; Gutterson and Reuber 2004. Current Opinion in Plant Biology, 7, 465-471). The availability to modulate gene expression in order to enhance yield traits would contribute improve crop performance and ultimately benefit agriculture based industries.

In eukaryotes, gene expression is coupled to chromatin modifications resulting in promoters becoming more accessible to RNA Polymerase II and other components of the transcriptional apparatus. Two main classes of protein complexes influence chromatin dynamics. One class comprises ATP-dependent chromatin-remodeling machines (SWI/SNF related complexes) and a second class comprises complexes that modify histone proteins. One such histone modification, mediated by histone acetyltransferases (HATs), may be by acetylacion of specific Lysine residues present in the N-terminus of core histones (Narlikar et al. 2002 Cell 108, 475-487). One of the prototypical histone acetyltransferases that functions as a transcriptional coactivator is known as Gcn5. In yeast, Gcn5 forms distinct protein complexes known to comprise different adaptor proteins such as ADA, SAGA, SALSA and SLIK [18-20]. Homologous complexes have been identified in higher eukaryotes including plants. In *Arabidopsis thaliana* two paralogous genes encoding ADA2 proteins have been described (Stockinger et al. 2001 Nucleic acid research 29, 1524-1533).

General transcription factors recruit RNA polymerase II to the TATA box of promoters while transcriptional activators bind to specific DNA sequences called the upstream activating sites (UAS). General transcription factors may interact directly with the transcriptional activator or through the adaptor proteins. Typically adaptor proteins interact with the transcription activator via the activation domain though interactions via the DNA biding domain have also been described (Mao et al. 2006. Biochimica et Biophysica Acta 1759 69-79).

In *Arabidopsis thaliana* ADA2 proteins reportedly enhance the ability of GCN5 to acetylate histones in vitro and modulate the substrates specificity of GCN5. Moreover, GCN5 can acetylate the ADA2 proteins at a motif unique to the plant homologs and absent from fungal and animal homologs (Mao et al. 2006). T-DNA insertion mutations in ADA2b and GCN5 were found to have pleiotropic effects on plant growth and development, including dwarf size, aberrant root development, and short petals and stamens in flowers (Vlachonasios et al. 2003 The Plant Cell, Vol. 15, 626-638). Genes encoding transcriptional adaptor proteins originating from other plant species have also been disclosed (WO0003026).

The regulation of many different cellular processes requires the use of protein interaction domains to direct association of polypeptides with one another, and with phospholipids, small molecules, or nucleic acids. One such protein interaction domain is called the WD repeat (see review Smith et al. (1999) TIBS 24: 181-185). WD repeat containing proteins are largely represented in most organisms, for example, more than 300 are counted in *H. sapiens*, more than 140 in *C. elegans*, more than 390 in *A. thaliana*, and more than 90 in *S. cereviseae*. Although structurally related by the presence of WD repeats (between 4 and 16 copies in one polypeptide), these proteins have very diverse functions.

The WD repeat is loosely defined at the primary sequence level by a Gly-His (GH) dipeptide 10-20 residues N-terminal from a Trp-Asp (WD) dipeptide (located at the C-terminus of the motif), and is typically approximately 40 (but up to 60) residues in length (hence the "WD40" name). However, neither the GH dipeptide nor the WD dipeptide is absolutely conserved. Between GH and WD is a conserved core sequence that can be identified using algorithms available, for example, at InterPro, hosted by the European Bioinformatics Institute (EBI) in the UK. InterPro is a database of protein families, domains and functional sites in which identifiable features found in known proteins can be applied to unknown protein sequences.

WD40 proteins are predicted to form a beta propeller-like structure (a circular repeating structure), which contains three potential interacting surfaces: the top, the bottom, and the circumference. This expansive surface area allows a WD40 protein to form complexes reversibly with several proteins, thus coordinating sequential and/or simultaneous interactions involving several sets of protein.

Among the very important protein complexes involving WD40 proteins is a class of multiprotein ubiquitin E3 ligases of which Cullin 4 (CUL4) and damaged DNA binding protein 1 (DDB1) are the core proteins (Higa et al. (2007) Cell Division 2:5; Angers et al. (2006) Nature 443: 590-593; Higa et al. (2006) Nature Cell Biol 8(11): 1277-1283; He et al. (2006) Genes & Development 20: 2949-2954). This complex docks WD40 proteins as molecular adaptors for substrate recruiting mechanism, which substrate will subsequently be ubiquitinated and destroyed. These WD40 proteins form a subclass called DCAF (DDB1-CUL4A-associated factor), and comprise two conserved DxR motifs at the end of two consecutive WD40 repeats (He et al. (2006) supra).

One such WD40 protein, WDR23 (WD repeat 23; also called DCAF11) has signicant primary sequence identity with a WD40 protein found in plants. This WD40 protein was first identified in *Lithospermum erythrorhizon* as clone 14B (LEC14B; NCBI accession number D83074).

In patent application WO2002/016655, SEQ ID NO: 2577 relates to an *Arabidopsis thaliana* nucleic acid sequence encoding a WDR23-like polypeptide, and is described a method of identifying a stress condition to which a plant cell has been exposed, using any one or more of SEQ ID NO: 1 through SEQ ID NO: 5379. In US patent application US2004/034888, SEQ ID NO: 13,294 relates to an *Arabidopsis thaliana* nucleic acid sequence encoding a WDR23-like polypeptide, and is described a method of producing a plant having an improved property, using any one or more of SEQ ID NO: 1 through SEQ ID NO: 36,564.

Surprisingly, it has now been found that modulating expression of a nucleic acid encoding a PRP38 polypeptide gives plants having enhanced (or improved) yield-related traits, in particular increased yield relative to control plants, also in conditions other than osmotic stress caused by salt, drought, cold or freezing.

Also surprisingly, it has now been found that modulating (preferably increasing) expression of a nucleic acid encoding a GATA-like polypeptide gives plants having significantly increased Thousand Kernel Weight (TKW) relative to control plants, while other seed yield parameters such as number of seeds (filled seeds or total number of seeds) were not significantly increased.

Furthermore, surprisingly, it has now been found that modulating expression of a nucleic acid encoding an ADA2 polypeptide gives plants having enhanced yield-related traits, in particular increased yield relative to control plants.

Also surprisingly, it has now been found that increasing expression of a nucleic acid sequence encoding a WDR23-like polypeptide as defined herein gives plants having increased yield-related traits relative to control plants.

Furthermore, surprisingly, it has now been found that modulating expression of a nucleic acid encoding a PATL polypeptide gives plants having enhanced yield-related traits, in particular increased yield relative to control plants.

According one embodiment of the present invention, there is provided a method for improving (or enhancing) yield related traits in a plant relative to control plants, comprising modulating expression of a nucleic acid encoding a PATL polypeptide, or a PRP38, or an ADA2 polypeptide in a plant.

According to another embodiment, there is provided a method for increasing Thousand Kernel Weight (TKW) relative to control plants, comprising modulating (preferably increasing) expression of a nucleic acid encoding a GATA-like polypeptide in a plant.

According to another embodiment, there is provided a method for increasing yield-related traits in plants relative to control plants, comprising increasing expression of a nucleic acid sequence encoding a WDR23-like polypeptide as defined herein, in a plant. The increased yield-related traits comprise one or more of: increased total seed yield per plant, increased seed filling rate, increased number of filled seeds, increased harvest index, or increased thousand kernel weight.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic acid(s)/Nucleic Acid Sequence (s)/ Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homoloque(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the Patellin, or the Precursor RNA Processing factor 38, or a GATA-like polypeptide, or the Adaptor 2, or the WDR23-like polypeptide, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Ortholoque(s)/Paraloque(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5° C. + 16.6 \times \log_{10}[Na^+]^a + 0.41 \times \% [G/C^b] - 500 \times [L^c]^{-1} - 0.61 \times \% \text{ formamide}$$

2) DNA-RNA or RNA-RNA hybrids:

$$Tm = 79.8 + 18.5(\log_{10}[Na^+]^a) + 0.58 (\% G/C^b) + 11.8 (\% G/C^b)^2 - 820/L^c$$

3) oligo-DNA or oligo-RNA$^d$ hybrids:

For <20 nucleotides: $T_m = 2 (l_n)$

For 20-35 nucleotides: $T_m = 22 + 1.46 (l_n)$ $^a$ or for other monovalent cation, but only accurate in the 0.01-0.4 M range.

$^b$ only accurate for % GC in the 30% to 75% range.

$^c$ L=length of duplex in base pairs.

$^d$ oligo, oligonucleotide; $l_n$, =effective length of primer=2× (no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, $3^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500,0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter. Typically a medium strength promoter is able to drive expression of a nucleic acid at least 3, 5, 10, 15, 20, 25, 30, 35, 40, 45, 50, 60, 70, 80, 90, 100 times lower that of the 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2 below gives examples of constitutive promoters.

TABLE 2

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table i below:

TABLE i

Examples of root-specific promoters

| Gene Source | Reference |
| --- | --- |
| Rice RCc3 | Xu et al (1995) Plant Mol Biol 27(2): 237-48 |
| Arabidopsis phosphate transporter PHT1 | Kovama et al., 2005 |
| Medicago phosphate transporter | Xiao et al., 2006 |
| Arabidopsis Pyk10 | Nitz et al. (2001) Plant Sci 161(2): 337-346 |
| Tobacco root-specific genes RB7, RD2, RD5, RH12 | Conkling et al. (1990) Plant Phys 93(3): 1203-1211 |
| Barley root-specific lectin | Lerner & Raikhel (1989) Plant Phys 91: 124-129 |
| Root-specific hydroxy-proline rich protein | Keller & Lamb (1989) Genes & Dev 3: 1639-1646 |
| Arabidopsis CDC27B/hobbit | Blilou et al. (2002) Genes & Dev 16: 2566-2575 |

A seed-specific promoter is transcriptionally active predominantly in seed tissue, but not necessarily exclusively in seed tissue (in cases of leaky expression). The seed-specific promoter may be active during seed development and/or during germination. Examples of seed-specific promoters are given in Qing Qu and Takaiwa (Plant Biotechnol. J. 2, 113-125, 2004), which disclosure is incorporated by reference herein as if fully set forth and in Table ii below.

TABLE ii

Examples of seed-specific promoters

| Gene source | Reference |
| --- | --- |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| Legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| Zein | Matzke et al Plant Mol Biol, 14(3): 323-32 1990 |
| NapA | Stalberg et al, Planta 199: 515-519, 1996. |
| Wheat LMW and HMW glutenin-1 | Mol Gen Genet 216: 81-90, 1989; NAR 17: 461-2, 1989 |
| Wheat SPA | Albani et al, Plant Cell, 9: 171-184, 1997 |
| Wheat α, β, γ-gliadins | EMBO J. 3: 1409-15, 1984 |
| Barley ltr1 promoter | Diaz et al. (1995) Mol Gen Genet 248(5): 592-8 |
| Barley B1, C, D, hordein | Theor Appl Gen 98: 1253-62, 1999; Plant J 4: 343-55, 1993; Mol Gen Genet 250: 750-60, 1996 |
| Barley DOF | Mena et al, The Plant Journal, 116(1): 53-62, 1998 |
| blz2 | EP99106056.7 |
| Synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| Maize ESR gene family | Plant J 12: 235-46, 1997 |
| Sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |

TABLE ii-continued

Examples of seed-specific promoters

| Gene source | Reference |
| --- | --- |
| PRO0117, putative rice 40S ribosomal protein | WO 2004/070039 |
| PRO0136, rice alanine aminotransferase | Unpublished |
| PRO0147, trypsin inhibitor ITR1 (barley) | Unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| Cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts. Examples of green tissue-specific promoters which may be used to perform the methods of the invention are shown in Table iii below.

TABLE iii

Examples of green tissue-specific promoters

| Gene | Expression | Reference |
| --- | --- | --- |
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of meristem-specific promoters which may be used to perform the methods of the invention are shown in Table iv below.

TABLE iv

Examples of meristem-specific promoters

| Gene source | Expression pattern | Reference |
| --- | --- | --- |
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze$^{-1}$ intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased epression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the Patellin, or the Precursor RNA Processing factor 38, or the Adaptor 2, or a WDR23-like polypeptide (target genes), or from any nucleic acid capable of encoding an orthologue, paralogue or homologue of the Patellin, or the Precursor RNA Processing factor 38, or the Adaptor 2, or a WDR23-like polypeptide. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

Examples of various methods for the reduction or substantial elimination of expression in a plant of an endogenous gene, or for lowering levels and/or activity of a protein, are known to the skilled in the art. A skilled person would readily be able to adapt the known methods for silencing, so as to achieve reduction of expression of an endogenous gene in a whole plant or in parts thereof through the use of an appropriate promoter, for example.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the Patellin, or the Precursor RNA Processing factor 38, or the Adaptor 2, or a WDR23-like polypeptide) is cloned as an inverted repeat (in part or completely), separated by a spacer (non-coding DNA).

Another method for the reduction or substantial elimination of endogenous gene expression is by RNA-mediated silencing using an inverted repeat of a nucleic acid sequence or a part thereof (in this case a stretch of substantially contiguous nucleotides derived from the gene of interest, or from any nucleic acid sequence capable of encoding an orthologue, paralogue or homologue of the Patellin, or the Precursor RNA Processing factor 38, or the Adaptor 2, or a WDR23-like polypeptide), preferably capable of forming a hairpin structure. Another example of an RNA silencing method involves the introduction of nucleic acid sequences or parts thereof (in this case a stretch of substantially contiguous nucleotides derived from the gene of interest, or from any nucleic acid sequence capable of encoding an orthologue, paralogue or homologue of the Patellin, or the Precursor RNA Processing factor 38, or the Adaptor 2, or a WDR23-like polypeptide) in a sense orientation into a plant. Another example of an RNA silencing method involves the use of antisense nucleic acid sequences. Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682). Other methods, such as the use of antibodies directed to an endogenous polypeptide for inhibiting its function in planta, or interference in the signalling pathway in which a polypeptide is involved, will be well known to the skilled man. Artificial and/or natural microRNAs (miRNAs) may be used to knock out gene expression and/or mRNA translation. Endogenous miRNAs are single stranded small RNAs of typically 19-24 nucleotides long. Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs (Schwab et al., (2005) Dev Cell 8(4):517-27). Convenient tools for design and generation of amiRNAs and their precursors are also available to the public (Schwab et al., (2006) Plant Cell 18(5):1121-33).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the Patellin, or the Precursor RNA Processing factor 38, or the Adaptor 2, or a WDR23-like polypeptide), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the Patellin, or the Precursor RNA Processing factor 38, or the Adaptor 2) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the Patellin, or the Precursor RNA Processing factor 38, or the Adaptor 2), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988)

Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. MiRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. CreI is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

Tilling

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei GP and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville CR, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss Physcomitrella. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; f) increased thousand kernel weight (TKW) and g) increased number of primary panicles, which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased seed yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Triticale* sp., *Triticosecale rimpaui*, *Triticum* spp. (e.g. *Triticum aestivum*, *Triticum durum*, *Triticum turgidum*, *Triticum hybernum*, *Triticum macha*, *Triticum sativum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

DETAILED DESCRIPTION OF THE INVENTION

Surprisingly, it has now been found that modulating expression in a plant of a nucleic acid encoding a PATL polypeptide, or a PRP38 polypeptide, or an GATA-like polypeptide, or an ADA2 polypeptide, or a WDR23-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a PATL polypeptide, or a PRP38 polypeptide, or an GATA-like polypeptide, or an ADA2 polypeptide, or a WDR23-like polypeptide and optionally selecting plants having enhanced yield-related traits.

In one embodiment, surprisingly, it has now been found that modulating (preferably increasing) expression in a plant of a nucleic acid encoding a GATA-like polypeptide gives plants having increased Thousand Kernel Weight (TKW) relative to control plants. According to a one embodiment, the present invention provides a method for enhancing TKW in plants relative to control plants, comprising modulating (preferably increasing) expression in a plant of a nucleic acid encoding a GATA-like polypeptide.

In another embodiment, it has now been found that increasing expression in a plant of a nucleic acid sequence encoding a WDR23-like polypeptide as defined herein, gives plants having increased yield-related traits relative to control plants. The invention provides nucleic acid sequences encoding WDR23-like polypeptides and WDR23-like polypeptides, whereby increased expression of the isolated nucleic acid sequences in plants increase yield-related traits relative to control plants.

A preferred method for modulating (preferably, increasing) expression of a nucleic acid encoding a PATL polypeptide, or a PRP38 polypeptide, or a GATA-like polypeptide, or ADA2 polypeptide, or a WDR23-like polypeptide is by introducing and expressing in a plant a nucleic acid encoding a PATL polypeptide, or a PRP38 polypeptide, or GATA-like polypeptide, or ADA2 polypeptide, or a WDR23-like polypeptide and optionally selecting for plants having enhanced yield-related traits.

Any reference hereinafter to a "protein useful in the methods of the invention" is taken to mean a PATL polypeptide, or a PRP38 polypeptide, or GATA-like polypeptide, or ADA2 polypeptide, or WDR23-like polypeptide as defined herein. Any reference hereinafter to a "nucleic acid useful in the methods of the invention" is taken to mean a nucleic acid capable of encoding such a PATL polypeptide, or a PRP38 polypeptide, or GATA-like polypeptide, or ADA2 polypeptide, or WDR23-like polypeptide. The nucleic acid to be introduced into a plant (and therefore useful in performing the methods of the invention) is any nucleic acid encoding the type of protein which will now be described, also named "PATL nucleic acid" or "PATL gene" or PRP38 nucleic acid" or "PRP38 gene", or "GATA-like nucleic acid" or "GATA-like gene", or "ADA2 nucleic acid" or "ADA2 gene", or "WDR23-like nucleic acid sequence" or "WDR23-like gene".

A "PATL polypeptide" as defined herein refers to any polypeptide comprising:
(i) a SEC14 domain and/or
(ii) a GOLD domain The SEC 14 and GOLD domains are typically located in the C-terminal region of PATL polypeptides. The N-terminus of PATL polypeptides is variable in length and has a more divergent amino acid sequence composition than the C-terminus. The N-terminus is characterized by enrichment in acidic amino acids (PI-isoelectric poing-approximately 4) such as Glutamic acid (E) and contains numerous EEK (Glutamic-Glutamic-Lysine) repeats. In addition the N-terminus sequence is predicted to comprise one or more coiled coil, which are a common protein oligomerization-folding motif. Coiled coil domain usually contain hydrophobic and hydrophilic amino acid residues that form alpha-helices which in a cytoplasmic enviroment may wrap the hydrophobic strands against each other between the hydrophilic amino acids providing thermodynamic driving force for dimerization. Coiled coils may be readily identified using methods and software well described in the art such as COILs or PAIR-CIOL2 (Lupas, et al; 1991. Science, 252, 1162-1164; Mac-Donnell et al. 2006. Bioinformatics; 22(3):356-8. FIG. 1 shows the characteristic EEK repeats and a coiled coil domain as present in SEQ ID NO: 2.

Preferred PATL polypeptides useful in the methods of the invention comprise an acidic N-terminus having one or more of the following features:
(i) an isoelectric point in increasing order of preference of below 5, 4.5, 4, 3.5, or 3;
(ii) one or more coiled coils, preferably in increasing order of preference one, two, three, four or five.
(iii) one or more EEK repeats, preferably in increasing order of preference one, two, three, four, five, six or seven.

The N-terminus of a PATL polypeptide as referred herein is the portion of the protein extending at the N-terminus of the SEC14 domain.

The isoelectric point of a polypeptide, that is, the pH at which a particular molecule or surface carries no net electrical charge, may be calculated by methods well known in the art (Stryer, 1995) using for example the Henderson-Hasselbalch equation (Henderson (1908), Am. J. Physiol., 21, 173-179; Hasselbalc (1917), Biochemische Zeitschrift, 78, 112-144. de Livie, (2003) J. Chem. Educ., 80, 146).

Typically, PATL polypeptides comprise a SEC14 domain following the above-described N-terminus. The SEC14 domain in PATL polypeptides includes a region of homology to the yeast Sec14p protein which comprises the phospholipid binding pocket. The E, K and G amino acid residues involved in lipid binding and/or transfer in the yeast Sec14p are conserved in PATL polypeptides, which in SEQ ID NO: 2 correspond to E434, K465, and G493 (FIG. 1). Glutamic acid E434 and Lysine K465 of SEQ ID NO: 2 are the homologous residues to E207 and K239 of the yeast Sec14p protein which form a salt bridge involved in selectivity and binding to PtdIns. The hydrophobic pocket of the yeast Sec14P is also conserved in PATL polypeptides.

PATL polypeptides may comprise a GOLD domain which is typically found at the C-terminus. The GOLD domain in PATL polypeptide is rich in Lysine residues and contains the conserved sequence KX(10-11)(K/R/T)KKKX(0-1)(L/V/A)(LN/A)YR (SEQ ID NO: 286; see FIG. 2) which is similar to the PtdIns (4,5)P2 binding motif found in clathrin-coated vesicle proteins.

A preferred PATL polypeptide useful in the methods of the invention comprises at least one of the following domains:
(i) A SEC14 domain as represented by SEQ ID NO: 71: lpeldsvvfyrgadreghpvcynvygefqdkdlyekafgdeekrerflk wriqllergilsqldfspsgicsmvqvtdlknsppmlgkhravtrqaval lqdnypefiakkvfinvpwwylaankmmspfltqrtkskfifaspaksaetlf ryiapeqvpvgqfgglfk, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 71, or to any SEC14 domain as present in any of the polypeptides of Table A;
(ii) A GOLD domain as represented by SEQ ID NO: 72: sdavteltikpssketveipvtenstig-welrvlgwevsygaeftpdaeg-gytvivqktrkvpaneepimkgsfkvgepg kivltinnpaskkkkllyr-skv, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 72, or to any GOLD domain as present in any of the polypeptides of Table A.

Further preferably a PATL polypeptide useful in the methods of the invention comprise at least one of the conserved motifs Motif Ia and Motif IIa as represented by SEQ ID NO: 69/L(L/T)KFLRAR and SEQ ID NO: 70/(L/F)(Q/E)DNYPEF respectively.

The PATL polypeptides useful in the methods of the invention are preferably those having in increasing order of preference at least 50%, 55%, 60%, 70%, 75%, 80%, 85%, 90%, 92%, 93%, 95%, 96%, 98% or more sequence identity to any of polypeptide given in Table A.

A SEC14 domain and a GOLD domain comprised in a PATL polypeptide may be identified by searching specialized databases containing collections of multiple sequence alignments and hidden Markov models covering conserved protein domains and families, such as Pfam which available at the Sanger Institute, United Kingdom. Alternatively the domains abovementioned may be found by scanning The Integrated Resource of Protein Families, Domains and Sites (InterPro) database to detect a significant sequence alignment with known SEC14 or GOLD domains (see Example 4). Interpro database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Interpro is hosted at the European Bioinformatics Institute in the United Kingdom. A significant alignment between the sequence of two polypeptides or two domains as defined herein is an alignment having in increasing order of preference an e-value lower than $e^{-5}$ (e to the minus 5), $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$ and $1.e^{-800}$. The polypeptide sequences may be aligned using any of the methods well known in the art, including global and local alignment methods such as Blast algorithms, e.g. the algorithm described in Altschul, S F, et al. (1990) J. Mol. Biol. 215:403-10. The probability for the alignment to occur with a given sequence is taken as basis for identifying similar polypeptides. A parameter that is typically used to represent such probability is called an e-value (E-value). The E-value is a measure of the reliability of the S score. The S score is a measure of the similarity of the two sequenced being aligned. The e-value describes how often a given S score is expected to occur at random. The e-value may be as high as 1.0.

Preferably PATL polypeptides useful in the methods of the invention comprise at least one of the following domains:
(i) a SEC14 domain having in increasing order of preference an e-value lower than $e^{-5}$ (e to the minus 5), $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$ and $1.e^{-800}$ when aligned with a known SEC14 domain, more preferably when aligned to any of the SEC14 domains of Table C;
(ii) a GOLD domain having in increasing order of preference an e-value lower than $e^{-5}$ (e to the minus 5), $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$ and $1.e^{-800}$ when aligned with a known GOLD domain, more preferably when aligned to any of the GOLD domains of Table C.

Preferably, the PATL polypeptide sequence useful in the methods of the invention is one which when used in the construction of a phylogenetic tree, such as the one depicted in FIG. 3, clusters with any of the sequences in the tree, more preferably with the sequences in group Ia which comprises SEQ ID NO: 2.

The term "domain" and "motif" is defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequence) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Furthermore, PATL polypeptides typically have Phosphatidylinositide (PtdIns) and/or Phosphatidylcholine (PtdCho) binding activity. Preferably they bind Phosphatidylinositol. Phosphatidylinositol refers to any glycophospholipid with its sn-glycerol 3-phosphate residue esterified to the 1-hydroxyl group of 1D-myo-inositol. Alternatively PATL polypeptides typically catalyze the transfer of Phosphatidylinosito and Phosphatidylcholine between membranes in vitro. Methods to assay PtdIns/PtdCho binding and or transfer through membranes are well know in the art (Bankaitis Va., et al. (1990). Nature 347: 561-2; Peterman et al. (2004)).

Alternatively, PATL nucleic acids may be identified in a functional complementation test by their ability to complement the defective growth phenotype of Saccharomyces cerevisie sec14 temperature sensitive mutants. In this in vivo, test the PATL nucleic acids are capable of expressing a PATL polypeptide in yeast. Several S. cerevisie sec14 temperature sensitive mutant strains and methods for their complementation are well known in the art (Kearns et al. (1998) EMBO J. 17, 4004-17; Kapranov et al. (2001); Lee et al. (2000) Biochym biophys Acta 1486:55-71).

In addition, PATL polypeptides, PRP38 polypeptides, GATA-like polypeptides, or ADA2 polypeptides, when expressed in rice and evaluated according to the methods of the present invention as outlined in Examples 7 and 8, give plants having enhanced yield related traits, in particular any one or more of total seed weight, seed filling rate, number of filled seeds and total number of flowers per panicle.

The present invention is illustrated by transforming plants with the nucleic acid sequence represented by SEQ ID NO: 1, encoding the polypeptide sequence of SEQ ID NO: 2, or SEQ ID NO: 76, encoding the polypeptide sequence of SEQ ID NO: 77, or SEQ ID NO: 128, encoding the polypeptide sequence of SEQ ID NO: 129, or SEQ ID NO: 181, encoding the polypeptide sequence of SEQ ID NO: 182, or SEQ ID NO: 215, encoding the WDR23-like polypeptide sequence of SEQ ID NO: 216. However, performance of the invention is not restricted to these sequences; the methods of the invention may advantageously be performed using any PATL-encoding nucleic acid or PATL polypeptide, PRP38-encoding nucleic acid or PRP38 polypeptide, or GATA-like-encoding nucleic acid or GATA-like polypeptide, or ADA2-encoding nucleic acid or ADA2 polypeptide, or a WDR23-like polypeptide as defined herein.

Examples of nucleic acids encoding PATL polypeptides, or PRP38 polypeptides, or GATA-like polypeptides, or ADA2 polypeptides, or WDR23-like polypeptides are given in Table A of Example 1 herein. Such nucleic acids are useful in performing the methods of the invention. The amino acid sequences given in Table A of Example 1 are example sequences of orthologues and paralogues of the PATL polypeptide represented by SEQ ID NO: 2, or of the PRP38 polypeptide represented by SEQ ID NO: 77 or of the GATA-like polypeptide represented by SEQ ID NO: 129, or of the ADA2 polypeptide represented by SEQ ID NO: 182, or of the WDR23-like polypeptide represented by SEQ ID NO: 216, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against Oryza sativa sequences; or where the query sequence is SEQ ID NO: 76 or SEQ ID NO: 77, SEQ ID NO: 128 or SEQ ID NO: 129, SEQ ID NO: 181 or SEQ ID NO: 182, or SEQ ID NO: 215 or SEQ ID NO: 216, the second BLAST would therefore be against Arabidopsis thaliana sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

PRP38 domain refers to a conserved amino acid sequence found in polypeptides that can function as pre-mRNA processing factors. It typically has about 170 amino acids in length, but is shorter in Ostta_PRP38_1 and longer in Vitvi_PRP38_1 polypeptides for example (see Table C). PRP38 domains can be represented by any one of the PRP38 domain sequences of Table C and by any polypeptide domain having in increasing order of preference at least 50%, 55%, 60%, 65%, 70%, 75%, 80%, 85%, 90%, 92%, 95%, 98% or more sequence identity to any one of the PRP38 domains of Table C. PRP38 domains may comprise one or more highly conserved sequence motifs as represented by SEQ ID NO: 123 and SEQ ID NO: 124.

Alternatively, a PRP38 domain may be defined as any polypeptide domain significantly aligning to a known PRP38 polypeptide, preferably to any one of the polypeptides of Table A. A significant alignment between two polypeptides or two domains as defined herein is an alignment having in increasing order of preference an e-value lower than e−5 (e to the minus 5), $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$ and $1.e^{-800}$. The polypeptide sequences may be aligned using any of the methods well known in the art, including global and local alignment methods such as Blast algorithms, e.g. the algorithm described in Altschul, S F, et al. (1990) J. Mol. Biol. 215:403-10. The probability for the alignment to occur with a given sequence is taken as basis for identifying similar polypeptides. A parameter that is typically used to represent such probability is called an e-value (E-value). The E-value is a measure of the reliability of the S score. The S score is a measure of the similarity of the query sequence to the known sequence comprising the PRP38 domain. The e-value describes how often a given S score is expected to occur at random. The e-value cut-off may be as high as 1.0.

Preferably PRP38 polypeptides useful in the methods of the invention comprise a PRP38 domain having in increasing order of preference an e-value lower than e−5, $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$ and $1.e^{-800}$ when aligned with a known PRP38 domain, more preferably when aligned to any one of the PRP38 domains of Table C.

A PRP38 domain occurring in a polypeptide may be identified by searching specialized databases containing collections of multiple sequence alignments and hidden Markov models covering conserved protein domains and families, such as Pfam which available at the Sanger Institute, United Kingdom. Example 2 herein shows the results of a Pfam search using PRP38 polypeptides as query sequence.

A DUF1777 domain is a conserved amino acid sequence found in a small subset of the proteins described to date. It is typically 140 to 150 amino acids in length, although much shorter versions are also found, see for example the DUF1777 domain of the Chlre_PRP38_1 polypeptide (Table C). DUF1777 domains have been identified in different living organism based on sequence homology. A compilation of DUF domains can be found in the Pfam database available at the Sanger Institute (UK). The presence of a DUF1777 domain in a polypeptide may be readily identified by searching specialized databases containing collections of multiple sequence alignments and hidden Markov models covering conserved protein domains and families, such as Pfam. A polypeptide comprising a DUF1777 domain will register as a hit with a previously known DUF1777 domain in a search in Pfam database. The amino acid sequences of DUF1777 domains in proteins of eukaryotic origin are often largely divergent, with only a few amino acid residues precisely conserved. Typically the e-value of an alignment of two DUF1777 domains is high, typically above 0.001, more typically above 0.01.

Preferably PRP38 polypeptides useful in the methods of the invention comprise a DUF1777 domain having in increasing order of preference an e-value lower than $1.e^{-5}$, $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$ and $1.e^{-800}$ when aligned with a known DUF1777 domain, more preferably when aligned to any one of the DUF1777 domains of Table C.

More preferably, PRP38 polypeptides useful in the methods of the invention comprise a DUF1777 having in increasing order of preference at least 50%, 55%, 60%, 65%, 70%, 75%, 80%, 85%, 90%, 92%, 95%, 98% or more sequence identity to any one of the DUF1777 domains of Table C.

A DUF1777 domain occurring in a polypeptide may be identified by searching specialized databases containing collections of multiple sequence alignments and hidden Markov models covering conserved protein domains and families, such as Pfam available at the Sanger Institute, United Kingdom. Example 2 herein shows the results of a Pfam search using PRP38 polypeptides as query sequence PRP38 polypeptides may comprise an RS domain. An RS domain is a polypeptide region rich in Arginine (R) and Serine (S) amino acid residues. RS domains comprise a multiplicity of dipeptides as represented by the sequence RS (Arginine-Serine), RE (Arginine-Glutamic acid), RD (Arginine-Aspartic acid). Typically the dipeptides are spread over a region of the PRP38 polypeptide extending from 4 to 150 amino acids. The dipeptides abovementioned may occur in clusters, such clusters composed exclusively of any one or more of the RS, RE, RD dipeptides and being typically between 4 and 40 amino acids long.

Preferably, the PRP38 polypeptides useful in the methods of the invention comprise one or more of the dipeptides RS, RE, RD in a stretch of 4, 6, 8, 10, 12, 14, 20, 24, 30, 40, 50, 100 or more until a maximum of 150 amino acids.

More preferably, the PRP38 polypeptides useful in the methods of the invention comprise two or more dipeptide clusters having exclusively RS, RE and/or RD amino acid residues. Further preferably, the PRP38 polypeptide comprises 4 dipeptide clusters, most preferably the dipeptide cluster represented by RSRSRSRS (SEQ ID NO: 287).

PRP38 polypeptides may additionally comprise any one or more of the following conserved sequence motifs:
(iv) SEQ ID NO: 120/Motif Ib: RRPPSVKASLSVSF-GQRAPHRASTRDSSPVRRT, or a motif having in increasing order of preference at least 50%, 55%, 60%, 65%, 70%, 75%, 80%, 85%, 90%, 95% or more sequence identity to Motif Ib; and/or
(v) SEQ ID NO: 121/Motif IIb: SPYIRA(I/V)GFLYLRY, or a motif having in increasing order of preference at least 50%, 55%, 60%, 65%, 70%, 75%, 80%, 85%, 90%, 95% or more sequence identity to Motif IIb; and/or
(vi) SEQ ID NO: 122/Motif IIIb: KLKDLYGD, or a motif having in increasing order of preference at least 50%, 55%, 60%, 65%, 70%, 75%, 80%, 85%, 90%, 95% or more sequence identity to Motif IIIb.

Preferably, PRP38 polypeptides useful in the methods of the invention comprise any one or more of the following motifs:
(i) Motif 1b (SEQ ID NO: 120) wherein any amino acid residue may be substituted by a conservative amino acid and/or up to 50% of the amino acid residues may be substituted by a non conservative amino acid.

(ii) Motif 1b (SEQ ID NO: 121) wherein any amino acid residue may be substituted by a conservative amino acid and/or up to 50% of the amino acid residues may be substituted by a non conservative amino acid.

(iii) Motif 1b (SEQ ID NO: 122) wherein any amino acid residue may be substituted by a conservative amino acid and/or up to 50% of the amino acid residues may be substituted by a non conservative amino acid.

The PRP38 polypeptides useful in the methods of the invention are preferably those having in increasing order of preference at least 50%, 55%, 60%, 70%, 75%, 80%, 85%, 90%, 92%, 93%, 95%, 96%; 6%; 98% or more sequence identity to any of polypeptide given in Table A.

Preferably, the PRP38 polypeptide sequence useful in the methods of the invention is one which when used in the construction of a phylogenetic tree, such as the one depicted in FIG. 8, clusters with any of the sequences in group Ib which comprises SEQ ID NO: 77.

Typically in PRP38 polypeptides, PRP38 domain is found at the N-terminus and DUF1777 domain at the C-terminus. PRP38 polypeptides typically have an acidic C-terminus and are localized in the nucleus.

Furthermore, PRP38 polypeptides typically have pre-mRNA splicing activity. Tools and techniques for measuring pre-mRNA splicing activity are well known in the art (Blanton S, et al. (1992) Mol Cell Biol 12(9):3939-47; Stevens SW and Abelson J (1999) Proc Natl Acad Sci USA 96(13):7226-31; Gottschalk A, et al. (1999) EMBO J 18(16):4535-48; Pandit S, et al. (2006) Proc Natl Acad Sci USA 103(37): 13700-5).

In addition, PRP38 polypeptides, when expressed in rice according to the methods of the present invention as outlined in Examples 7 and 8, give plants having enhanced yield related traits, in particular any one or more of above ground leaf biomass, emergence vigour, total seed weight, seed filling rate, harvest index, and total number of seeds.

The present invention is illustrated by transforming plants with the nucleic acid sequence represented by SEQ ID NO: 76, encoding the polypeptide sequence of SEQ ID NO: 77. However, performance of the invention is not restricted to these sequences; the methods of the invention may advantageously be performed using any PRP38-encoding nucleic acid or PRP38 polypeptide as defined herein.

A "GATA-like polypeptide" as defined herein refers to any Zn finger transcription factor comprising a GATA domain (as defined in for example the SMART database under accession SM00401). Preferably, the "GATA-like polypeptide" useful in the methods of the present invention comprises a single GATA domain with 18 or 20 amino acids between the second and the third Cys residue of the Zn finger, more preferably there are 18 amino acids between the second and the third Cys residue of the Zn finger (CX2CX18CX2C) (SEQ ID NO: 288). The term "zinc finger" or "Zn finger" is known in the art and refers to the sequence motif in which cysteines and/or histidines coordinate a zinc atom to form local peptide structures that are required for specific functions.

Further preferably, the GATA-like polypeptide useful in the methods of the present invention belongs to subfamily II as defined by Reyes et al. (Plant Physiol. 134, 1718-1732, 2004). Subfamily II GATA transcription factors typically consists of genes with 2 or 3 exons, where the zinc finger has been split between the 2 last exons. Subfamily II GATA transcription factors also has 18 residues in the Zn finger loop.

The GATA domain in the GATA-like polypeptide useful in the methods of the present invention preferably comprises a Class B type Zn finger as defined in Reyes et al. (2004). Class B Zn finger domains have 18 residues in the Zn finger loop, and are further characterised by the presence of a conserved Ser residue (in position 27 of the GATA domain shown in FIG. 11) and a conserved IRX(R/K)K motif.

Preferably, the GATA domain comprises motif 1c and/or motif 2c:

Motif 1c (SEQ ID NO: 130):
C(S/A/T)(D/E/N)CXT(T/S/A)(K/S)TP(L/M)WR(S/G/N)GP wherein X can be any amino acid, preferably X is one of N, K, G, H, D.

Motif 2c (SEQ ID NO: 131): GPKSLCNACGIRX(R/K)K wherein X can be any amino acid, preferably X is one of Q, H, N, S, Y, F.

Preferably, the GATA-like polypeptide useful in the methods of the present invention also comprises motif 3c (SEQ ID NO: 132:
(A/S)(A/W)X(L/C)(L/N)(M/L/V)(T/L/A)(L/D)(S/R)

wherein X can be any amino acid, preferably X is one of M, L, V, I, R.

Alternatively, the homologue of a GATA-like protein has in increasing order of preference at least 14%, 15%, 20%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 129, provided that the homologous protein comprises the GATA domain as defined above and one or more of the conserved motifs of above. The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered, such as the GATA domain.

Preferably, the polypeptide sequence which when used in the construction of a phylogenetic tree, such as the one depicted in FIG. 11 or FIG. 14 in Reyes et al. (2004), clusters with the "Subfamily II" group of GATA-like polypeptides as defined in Reyes et al. (2004), comprising the amino acid sequence represented by SEQ ID NO: 129, rather than with any other group.

Furthermore, GATA-like polypeptides (at least in their native form) typically have DNA-binding activity activity. The consensus DNA sequence that is recognised by the GATA-Zn finger is [AT]GATA[AG]. Tools and techniques for measuring DNA binding activity are well known in the art, see for example Teakle et al. (Plant Mol. Biol. 50, 43-57, 2002) or Ghirlando and Trainor (J. Biol. Chem. 278, 45620-45628, 2003).

In addition, GATA-like polypeptides, when expressed in rice according to the methods of the present invention as outlined in Examples 7 and 8, give plants having increased Thousand Kernel Weight.

The present invention is illustrated by transforming plants with the nucleic acid sequence represented by SEQ ID NO: 128, encoding the polypeptide sequence of SEQ ID NO: 129. However, performance of the invention is not restricted to these sequences; the methods of the invention may advantageously be performed using any GATA-like-encoding nucleic acid or GATA-like polypeptide as defined herein.

An "ADA2 polypeptide" as defined herein refers to any transcriptional adaptor polypeptide comprising two or more of the following motifs:
(vii) a Zinc (Zn) finger ZZ type domain
(viii) a SANT DNA binding domain
(ix) a Calcium EF hand domain
(x) a SWIRM domain A prototype of Zinc (Zn) finger ZZ type domain is present in dystrophin, CBP/p300 protein. The Cys-x2-Cys motifs in ZZ domains are reminiscent of the Cys-x2-Cys knuckles that occur in zinc fingers. Four to six cysteine residues in the domain sequence are responsible for coordinating zinc ions, to reinforce the structure (Ponting et al. Trends Biochem Sci 1996; 21:11-13). The Zinc finger ZZ type domain in ADA2 polypeptides could be involved in facilitating protein-protein interactions. A fragment of *Arabidopsis thaliana* ADA2a and ADA2b proteins comprising the ZZ zinc finger domain has been shown to bind to GCN5 protein (Mao et al 2006).

A SANT DNA binding domain is a subfamily of the Myb DNA binding domain (Aasland et al. 1996 Trends Biochem Sci 1996; 21:87-88). Polypeptides comprising SANT DNA binding domains specifically recognize the sequence YAAC(G/T)G present in a gene promoter. Preferred ADA polypeptides useful in the methods of the invention bind to a gene promoter comprising the sequence YAAC(G/T)G where Y can be C or T).

The SWIRM domain (Pfam accession number PF04433) is a small alpha-helical domain of about 85 amino acid residues found in eukaryotic chromosomal proteins. It is named after the proteins SWI3, RSC8 and MOIRA in which it was first recognized. This domain is predicted to mediate protein-protein interactions in the assembly of chromatin-protein complexes Lenkart et al. Proc Natl Acad Sci USA. 2006; 103:2057-2062).

A Calcium (Ca) binding EF hand domain consists of a twelve residue loop flanked on both side by a twelve residue alpha-helical domain. In an EF-hand loop the calcium ion is coordinated in a pentagonal bipyramidal configuration. The six residues involved in the binding are in positions 1, 3, 5, 7, 9 and 12; these residues are denoted by X, Y, Z, -Y, -X and -Z. The invariant Glu or Asp at position 12 provides two oxygens for liganding Ca (bidentate ligand) (Finn and Forsen 1995 Structure, 3:7-11).

A preferred ADA2 polypeptide useful in the methods of the invention comprises two or more of the following domains:
(i) A Zinc (Zn) finger ZZ type domain as represented by SEQ ID NO: 207: kpglyccnycdkdlsglvrfkcavcmd-fdlcvecfsvgvelnrhkn or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 207 or to any Zn finger ZZ type domain as present in any one of the polypeptides of Table A;
(ii) A SANT DNA binding domain as represented by SEQ ID NO: 208: vtsdwnadeeillleaiatygfgnwke-vadhvgskttecikhfnsaym, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 208 or to any SANT domain as present in any one of the polypeptides of Table A;
(iii) A Ca binding EF hand domain as represented by SEQ ID NO: 209: dndaeqlladmef, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 209 or to any Ca binding EF hand domain as present in any one of the polypeptides of Table A;
(iv) A SWIRM domain as represented by SEQ ID NO: 210: priysgldtwdvdgllgadllsetekkm-cnetrilpvhylkmldiltreikkg-qikkksdaysffkvepskvdrvydmlvhkgi gdst, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 210 or to any SWRIM domain as present in any one of the polypeptides of Table A.

The ADA2 polypeptides useful in the methods of the invention are preferably those having in increasing order of preference at least 50%, 55%, 60%, 70%, 75%, 80%, 85%, 90%, 92%, 93%, 95%, 96%, 98% or more sequence identity to any of polypeptide given in Table A.

A Zinc (Zn) finger ZZ type domain, a SANT DNA binding, a Calcium EF hand domain and a SWIRM domain comprised in a polypeptide may be identified by searching specialized databases containing collections of multiple sequence alignments and hidden Markov models covering conserved protein domains and families, such as Pfam which available at the Sanger Institute, United Kingdom. Alternatively the domains abovementioned may be found by scanning The Integrated Resource of Protein Families, Domains and Sites (InterPro) database to detect a significant sequence alignment with known Zinc (Zn) finger ZZ type domain, a SANT DNA binding, a Calcium EF hand domain and a SWIRM domain. Interpro database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Interpro is hosted at the European Bioinformatics Institute in the United Kingdom. A significant alignment between the sequence of two polypeptides or two domains as defined herein is an alignment having in increasing order of preference an e-value lower than $e^{-5}$ (e to the minus 5), $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$, $1.e^{-800}$. The polypeptide sequences may be aligned using any of the methods well known in the art, including global and local alignment methods such as Blast algorithms, e.g. the algorithm described in Altschul, S F, et al. (1990) J. Mol. Biol. 215:403-10. The probability for the alignment to occur with a given sequence is taken as basis for identifying similar polypeptides. A parameter that is typically used to represent such probability is called an e-value (E-value). The E-value is a measure of the reliability of the S score. The S score is a measure of the similarity of the two sequenced being aligned. The e-value describes how often a given S score is expected to occur at random. The e-value may be as high as 1.0.

Preferably ADA2 polypeptides useful in the methods of the invention comprise two or more of the following domains:
(i) A Zinc (Zn) finger ZZ type domain having in increasing order of preference an e-value lower than e-5, 1.e-10, 1.e-15, 1.e-20, 1.e-25, 1.e-50, 1.e-75, 1.e-100, 1.e-200, 1.e-300, 1.e$^{-400}$, 1.e-500, 1.e-600, 1.e-700 and 1.e-800 when aligned with a known Zn finger ZZ type domain, more preferably when aligned to any one of the Zn finger ZZ type of Table C;
(ii) A SANT DNA binding domain having in increasing order of preference an e-value lower than e-5, 1.e-10, 1.e-15, 1.e-20, 1.e-25, 1.e-50, 1.e-75, 1.e-100, 1.e-200, 1.e-300, 1.e-400, 1.e-500, 1.e-600, 1.e-700 and 1.e-800 when aligned with a known SANT DNA binding domain, more preferably when aligned to any one of the SANT DNA binding domain domains of Table C;
(iii) A Calcium EF hand domain having in increasing order of preference an e-value lower than e-5, 1.e-10, 1.e-15, 1.e-20, 1.e-25, 1.e-50, 1.e-75, 1.e-100, 1.e-200, 1.e-300, 1.e-400, 1.e-500, 1.e-600, 1.e-700 and 1.e-800 when aligned with a known Calcium EF hand domain, more preferably when aligned to any one of the Calcium EF hand domains of Table C.
(iv) A SWIRM domain having in increasing order of preference an e-value lower than e-5, 1.e$^{-10}$, 1.e-15, 1.e-20, 1.e-25, 1.e-50, 1.e-75, 1.e-100, 1.e-200, 1.e-300, 1.e-400, 1.e-500, 1.e$^{-600}$, 1.e-700 and 1.e-800 when aligned with a known SWIRM domain domain, more preferably when aligned to any one of the SWIRM domain domains of Table C.

Alternatively, an ADA2 polypeptide may be defined as any polypeptide significantly aligning to a known ADA2 polypeptide, preferably to any one of the polypeptides of Table A.

Preferably, the ADA2 polypeptide sequence useful in the methods of the invention is one which when used in the construction of a phylogenetic tree, such as the one depicted in FIG. 17, clusters with any of the sequences in the tree, more preferably with the sequences in group Id which comprises SEQ ID NO: 182.

Typically in ADA2 polypeptides, Zn Finger ZZ domain is found at the N-terminus, the SANT-DNA binding domain in the central portion and the SWIRM domain is found at the C-terminus. ADA2 polypeptides and typically localized in the nucleus of the cell. The plant ADA2 polypeptides may comprise a nuclear localization signal as for example that shown in FIG. 15 for SEQ ID NO: 182.

Furthermore, ADA2 polypeptides typically enhance the ability of GCN5 to acetylate histones in vitro and enable GCN5 to acetylate nucleosomal histones. Tools and techniques for measuring histone acetylation have been previously described (Stockinger et al 2001; Mao et al. 2006). Regulation of the activity of ADA2 polypeptides of plant origin in plant cells may occur via acetylation. It has been proposed that lysine residues K257 and K215 in ADA2a in ADA2b of *Arabidopsis thalina* could be acetylated.

The invention provides nucleic acid sequences encoding WDR23-like polypeptides and WDR23-like polypeptides, whereby increased expression of the isolated nucleic acid sequences in plants increase yield-related traits relative to control plants.

According to one embodiment of the present invention, there is therefore provided an isolated nucleic acid sequence encoding a WDR23-like polypeptide comprising:
(i) an isolated nucleic acid sequence as represented by SEQ ID NO: 219, SEQ ID NO: 225, or SEQ ID NO: 229;
(ii) the complement of an isolated nucleic acid sequence as represented by SEQ ID NO: 219, SEQ ID NO: 225, or SEQ ID NO: 229;
(iii) an isolated nucleic acid sequence encoding a polypeptide sequence as represented by SEQ ID NO: 220, SEQ ID NO: 226, or SEQ ID NO: 230;
(iv) an isolated nucleic acid sequence deduced from a polypeptide sequence as represented by SEQ ID NO: 220, SEQ ID NO: 226, or SEQ ID NO: 230, as a result of the degeneracy of the genetic code;
(v) an isolated nucleic acid sequence capable of stringently hybridising to a nucleic acid sequence as represented by SEQ ID NO: 219, SEQ ID NO: 225, or SEQ ID NO: 229, or to its complement;
(vi) an isolated nucleic acid sequence which encodes a polypeptide having in increasing order of preference at least 50%, 55%, 60%, 65%, 70%, 75%, 80%, 85%, 90%, 95%, 96%, 97%, 98%, 99% or more amino acid sequence identity with a polypeptide sequence as represented by SEQ ID NO: 220, SEQ ID NO: 226, or SEQ ID NO: 230;
(iv) an isolated nucleic acid sequence which encodes a polypeptide comprising a domain having, in increasing order of preference, at least 65%, 70%, 75%, 80%, 85%, 90%, 95%, 96%, 97%, 98%, 99% or more amino acid sequence identity with a Conserved Domain as represented by SEQ ID NO: 271.

According to a further embodiment of the present invention, there is also provided an isolated WDR23-like polypeptide comprising:
(i) a polypeptide sequence represented by SEQ ID NO: 220, SEQ ID NO: 226, or SEQ ID NO: 230;
(ii) a polypeptide sequence having, in increasing order of preference, at least 50%, 55%, 60%, 65%, 70%, 75%, 80%, 85%, 90%, 95%, 96%, 97%, 98%, 99% amino acid sequence identity with a polypeptide sequence as represented by SEQ ID NO: 220, SEQ ID NO: 226, or SEQ ID NO: 230;
(iii) a polypeptide comprising a domain having, in increasing order of preference, at least 65%, 70%, 75%, 80%, 85%, 90%, 95%, 96%, 97%, 98%, 99% or more amino acid sequence identity with a Conserved Domain as represented by SEQ ID NO: 271;
(iii) derivatives of any of the polypeptide sequences given in (i) to (iii) above.

According to a further embodiment, the present invention provides a method for increasing yield-related traits in plants relative to control plants, comprising increasing expression in a plant of a nucleic acid sequence encoding a WDR23-like polypeptide.

A preferred method for increasing expression of a nucleic acid sequence encoding a WDR23-like polypeptide is by introducing and expressing in a plant a nucleic acid sequence encoding a WDR23-like polypeptide.

Any reference hereinafter to a "polypeptide useful in the methods of the invention" is taken to mean a WDR23-like polypeptide as defined herein. Any reference hereinafter to a "nucleic acid sequence useful in the methods of the invention" is taken to mean a nucleic acid sequence capable of encoding such a WDR23-like polypeptide. The nucleic acid sequence to be introduced into a plant (and therefore useful in performing the methods of the invention) is any nucleic acid sequence encoding the type of polypeptide, which will now be described, hereafter also named "WDR23-like nucleic acid sequence" or "WDR23-like gene".

A "WDR23-like polypeptide" as defined herein refers to any polypeptide comprising a domain having at least 65%, 70%, 75%, 80%, 85%, 90%, 95%, 98%, 99% or more amino acid sequence identity to a Conserved Domain (CD) as represented by SEQ ID NO: 271.

Alternatively or additionally, a "WDR23-like polypeptide" as defined herein refers to any polypeptide comprising: (i) at least four WD40 repeats with a PFAM accession PF00400; and (ii) at least two conserved DxR motifs at the end of two consecutive WD40 repeats.

Alternatively or additionally, a "WDR23-like polypeptide" as defined herein refers to any polypeptide having, in increasing order of preference, at least 50%, 55%, 60%, 65%, 70%, 75%, 80%, 85%, 90%, 95%, 98%, 99% or more amino acid sequence identity to the WDR23-like polypeptide as represented by SEQ ID NO: 216 or to any of the polypeptide sequences given in Table A herein.

Analysis of the polypeptide sequence of SEQ ID NO: 216 is presented below in Example 4 herein. For example, a WDR23-like polypeptide as represented by SEQ ID NO: 216 comprises at least four WD40 repeats with a PFAM accession PF00400. Domains may also be identified using routine techniques, such as by sequence alignment. An alignment of the full length polypeptides of Table A herein, is shown in FIG. 23. Such alignments are useful for identifying the most conserved domains between the WDR23-like polypeptides, such as the conserved Domain (CD) as represented by SEQ ID NO: 271 (comprised in SEQ ID NO: 216).

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., (2003) BMC Bioinformatics, 10: 29. MatGAT: an application that generates similarity/identity matrices using protein or DNA sequences). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid sequence or polypeptide sequence or over selected domains or conserved motif(s), using the programs mentioned above using the default parameters. Example 3 herein describes in Table B the percentage identity between the WDR23-like polypeptide as represented by SEQ ID NO: 216 and the full length WDR23-like polypeptides listed in Table A, which can be as low as 54% amino acid sequence identity. The percentage identity can be increased to 69% if the identity calculation is performed between the Conserved Domain (CD) as represented by SEQ ID NO: 271 (comprised in SEQ ID NO: 216) and the Conserved Domain of the WDR23-like polypeptides of Table A and represented in FIG. 23. The results of such calculations are presented in Table B of the present application.

The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Furthermore, WDR23-like polypeptides useful in the methods of the present invention (at least in their native form) typically are capable of interacting with other polypeptides, through their WD40 repeat motifs. Many assays exist to protein-protein activity, such as yeast two-hybrid assays, tandem-affinity purification (TAP) followed by mass spectrometry, co-affinity purification, etc.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table A of Example 1, the terms "homologue" and "derivative" being as defined herein. Also useful in the methods of the invention are nucleic acids encoding homologues and derivatives of orthologues or paralogues of any one of the amino acid sequences given in Table A of Example 1. Homologues and derivatives useful in the methods of the present invention have substantially the same biological and functional activity as the unmodified protein from which they are derived.

Further nucleic acid variants useful in practising the methods of the invention include portions of nucleic acids encoding PATL, or PRP38, or GATA-like or ADA2, or WDR23-like polypeptides polypeptides, nucleic acids hybridising to nucleic acids encoding PATL, or PRP38, or GATA-like or ADA2, or WDR23-like polypeptides polypeptides, splice variants of nucleic acids encoding PATL, or PRP38, or GATA-like or ADA2, or WDR23-like polypeptides polypeptides, allelic variants of nucleic acids encoding PATL, or PRP38, or GATA-like or ADA2, or WDR23-like polypeptides polypeptides and variants of nucleic acids encoding PATL, or PRP38, or GATA-like or ADA2, or WDR23-like polypeptides polypeptides obtained by gene shuffling. The terms hybridising sequence, splice variant, allelic variant and gene shuffling are as described herein.

Nucleic acids encoding PATL, or PRP38, or GATA-like or ADA2, or WDR23-like polypeptides polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A of Example 1, or a portion of a nucleic acid encoding an orthologue, paralogue or homologue of any of the amino acid sequences given in Table A of Example 1.

A portion of a nucleic acid may be prepared, for example, by making one or more deletions to the nucleic acid. The portions may be used in isolated form or they may be fused to other coding (or non-coding) sequences in order to, for example, produce a protein that combines several activities.

When fused to other coding sequences, the resultant polypeptide produced upon translation may be bigger than that predicted for the protein portion.

Portions useful in the methods of the invention, encode a PATL, or PRP38, or ADA2 polypeptide as defined herein, and have substantially the same biological activity as the amino acid sequences given in Table A of Example 1. Portions useful in the methods of the invention comprise a protein domain having in increasing order of preference 50%, 55%, 60%, 70%, 75%, 80%, 85%, 90%, 92%, 93%, 95%, 96%; 98% or more sequence identity to any one of the conserved domains defined in Table C. Preferably, the portion is a portion of any one of the nucleic acids given in Table A of Example 1, or is a portion of a nucleic acid encoding an orthologue or paralogue of any one of the amino acid sequences given in Table A of Example 1. Preferably the portion is at least 50, 100, 150, 200, 300, 400, 500, 550, 600, 650, 700, 750, 800, 850, 900, 950, 1000, 1200 or more consecutive nucleotides in length, the consecutive nucleotides being of any one of the nucleic acid sequences given in Table A of Example 1, or of a nucleic acid encoding an orthologue or paralogue of any one of the amino acid sequences given in Table A of Example 1. Preferably, the portion encodes a fragment of an amino acid sequence which, when used in the construction of a phylogenetic tree, such as the one depicted in FIG. 3, clusters with any of the sequences in the tree, more preferably with the sequences in group Ia which comprises SEQ ID NO: 2. Further preferably, the portion is a portion of the nucleic acid of SEQ ID NO: 76, most preferably is portion as represented by SEQ ID NO: 82. Preferably, the portion encodes a fragment of an amino acid sequence which, when used in the construction of a phylogenetic tree, such as the one depicted in FIG. 8, clusters with any of the sequences in group Ib, which comprises SEQ ID NO: 77.

Concerning GATA-like polypeptides, portions useful in the methods of the invention, encode a GATA-like polypeptide as defined herein, and have substantially the same biological activity as the amino acid sequences given in Table A of Example 1. Preferably, the portion is a portion of any one of the nucleic acids given in Table A of Example 1, or is a portion of a nucleic acid encoding an orthologue or paralogue of any one of the amino acid sequences given in Table A of Example 1. Preferably the portion is at least 500, 550, 600, 650, 700, 750, 800, 850, 900, 950, 1000, 1050 consecutive nucleotides in length, the consecutive nucleotides being of any one of the nucleic acid sequences given in Table A of Example 1, or of a nucleic acid encoding an orthologue or paralogue of any one of the amino acid sequences given in Table A of Example 1. Most preferably the portion is a portion of the nucleic acid of SEQ ID NO: 128. Preferably, the portion encodes a fragment of an amino acid sequence which, when used in the construction of a phylogenetic tree, such as the one depicted in FIG. 11 or FIG. 14 in Reyes et al. (2004), clusters with the "Subfamily II" group of GATA-like polypeptides as defined in Reyes et al. (2004), comprising the amino acid sequence represented by SEQ ID NO: 129, rather than with any other group.

Portions useful in the methods of the invention, encode a WDR23-like polypeptide as defined herein, and have substantially the same biological activity as the polypeptide sequences given in Table A of Example 1. Preferably, the portion is a portion of any one of the nucleic acid sequences given in Table A of Example 1, or is a portion of a nucleic acid sequence encoding an orthologue or paralogue of any one of the polypeptide sequences given in Table A of Example 1. Preferably the portion is, in increasing order of preference at least 400, 450, 500, 550, 600, 650, 700, 750, 800, 850, 900, 950, 1000, 1050, 1100, 1150, 1200, 1250, 1300, 1350, 1400, 1450, 1480 or more consecutive nucleotides in length, the consecutive nucleotides being of any one of the nucleic acid sequences given in Table A of Example 1, or of a nucleic acid sequence encoding an orthologue or paralogue of any one of the polypeptide sequences given in Table A of Example 1. Preferably, the portion is a portion of a nucleic sequence encoding a polypeptide sequence polypeptide comprising a domain having at least 65%, 70%, 75%, 80%, 85%, 90%, 95%, 98%, 99% or more amino acid sequence identity to a Conserved Domain (CD) as represented by SEQ ID NO: 271. Most preferably, the portion is a portion of the nucleic acid sequence of SEQ ID NO: 215.

Another nucleic acid variant useful in the methods of the invention is a nucleic acid capable of hybridising, under reduced stringency conditions, preferably under stringent conditions, with a nucleic acid encoding a PATL, or PRP38, or GATA-like, or ADA2, or WDR23-like polypeptide as defined herein, or with a portion there of as defined herein.

According to the present invention, there is provided a method for enhancing yield-related traits in plants, comprising introducing and expressing in a plant a nucleic acid capable of hybridizing to any one of the nucleic acids given in Table A of Example 1, or comprising introducing and expressing in a plant a nucleic acid capable of hybridising to a nucleic acid encoding an orthologue, paralogue or homologue of any of the nucleic acid sequences given in Table A of Example 1.

Hybridising sequences useful in the methods of the invention encode a PATL, or PRP38, or GATA-like, or ADA2, or WDR23-like polypeptide as defined herein, having substantially the same biological activity as the amino acid sequences given in Table A of Example 1. Preferably, the hybridising sequence is capable of hybridising to any one of the nucleic acids given in Table A of Example 1, or to a portion of any of these sequences, a portion being as defined above, or the hybridising sequence is capable of hybridising to a nucleic acid encoding an orthologue or paralogue of any one of the amino acid sequences given in Table A of Example 1. Most preferably, the hybridising sequence is capable of hybridising to a nucleic acid as represented by SEQ ID NO: 1 or to a portion thereof or to SEQ ID NO: 76 or to a portion thereof, or to SEQ ID NO: 128 or to a portion thereof, or to SEQ ID NO: 181 or to a portion thereof. Concerning the WDR23-like sequences, preferably, the hybridising sequence is capable of hybridising to a nucleic acid sequence encoding a polypeptide sequence comprising a domain having at least 65%, 70%, 75%, 80%, 85%, 90%, 95%, 98%, 99% or more amino acid sequence identity to a Conserved Domain (CD) as represented by SEQ ID NO: 271. Most preferably, the hybridising sequence is capable of hybridising to a nucleic acid sequence as represented by SEQ ID NO: 215 or to a portion thereof.

Preferably, the hybridising sequence encodes a polypeptide with an amino acid sequence which, when full-length and used in the construction of a phylogenetic tree, such as the one depicted in FIG. 3, clusters with any of the sequences in the tree, more preferably with the sequences in group Ia which comprises SEQ ID NO: 2 or as the one depicted in FIG. 8, clusters with any of the sequences in group Ib, which comprises SEQ ID NO: 77. Also preferably, the hybridising sequence encodes a polypeptide with an amino acid sequence which, when full-length and used in the construction of a phylogenetic tree, such as the one depicted in FIG. 11 or FIG. 14 in Reyes et al. (2004), clusters with the "Subfamily II" group of GATA-like polypeptides as defined in Reyes et al. (2004), comprising the amino acid sequence represented by SEQ ID NO: 129, rather than with any other group.

Another nucleic acid variant useful in the methods of the invention is a splice variant encoding a PATL, or PRP38, or GATA-like, or ADA2, or WDR23-like polypeptide as defined hereinabove, a splice variant being as defined herein.

According to the present invention, there is provided a method for enhancing yield-related traits in plants, comprising introducing and expressing in a plant a splice variant of any one of the nucleic acid sequences given in Table A of Example 1, or a splice variant of a nucleic acid encoding an orthologue, paralogue or homologue of any of the amino acid sequences given in Table A of Example 1.

Preferred splice variants are splice variants of a nucleic acid represented by SEQ ID NO: 1, or a splice variant of a nucleic acid encoding an orthologue or paralogue of SEQ ID NO: 2. More preferably the splice variant is a variant of SEQ ID NO: 1. Preferably, the amino acid sequence encoded by the splice variant, when used in the construction of a phylogenetic tree, such as the one depicted in FIG. 3, clusters with any of the sequences in the tree, more preferably with the sequences in group Ia which comprises SEQ ID NO: 2.

Other preferred splice variants are splice variants of a nucleic acid represented by SEQ ID NO: 76, or a splice variant of a nucleic acid encoding an orthologue or paralogue of SEQ ID NO: 77. More preferably the splice variant is a variant of SEQ ID NO: 76, most preferably is a splice variant as represented by SEQ ID NO: 80. Preferably, the amino acid sequence encoded by the splice variant, when used in the construction of a phylogenetic tree, such as the one depicted in FIG. 8, clusters with any of the sequences in group Ib, which comprises SEQ ID NO: 77.

More preferred splice variants are splice variants of a nucleic acid represented by SEQ ID NO: 128, or a splice variant of a nucleic acid encoding an orthologue or paralogue of SEQ ID NO: 129. Preferably, the amino acid sequence encoded by the splice variant, when used in the construction of a phylogenetic tree, such as the one depicted in FIG. 11 or FIG. 14 in Reyes et al. (2004), clusters with the "Subfamily II" group of GATA-like polypeptides as defined in Reyes et al. (2004), comprising the amino acid sequence represented by SEQ ID NO: 129, rather than with any other group.

Further preferred splice variants are splice variants of a nucleic acid represented by SEQ ID NO: 181, or a splice variant of a nucleic acid encoding an orthologue or paralogue of SEQ ID NO: 182. More preferably the splice variant is a variant of SEQ ID NO: 181. Preferably, the amino acid sequence encoded by the splice variant, when used in the construction of a phylogenetic tree, such as the one depicted in FIG. 17, clusters with any of the sequences in the tree, more preferably with the sequences in group Id which comprises SEQ ID NO: 182.

The human ortholog WRD23 is present as multiple isoforms (NCBI accession AK057636.1), so that splice variants are also predicted for plant nucleic acid sequences encoding WRD23-like polypeptides.

Concerning the WDR23-like sequences, preferred splice variants are splice variants of a nucleic acid sequence represented by SEQ ID NO: 215, or a splice variant of a nucleic acid sequence encoding an orthologue or paralogue of SEQ ID NO: 216. Preferably, the splice variant is a splice variant of a nucleic acid sequence encoding a polypeptide sequence comprising a domain having at least 65%, 70%, 75%, 80%, 85%, 90%, 95%, 98%, 99% or more amino acid sequence identity to a Conserved Domain (CD) as represented by SEQ ID NO: 271.

Another nucleic acid variant useful in performing the methods of the invention is an allelic variant of a nucleic acid encoding a PATL, or PRP38, or GATA-like, or ADA2, or WDR23-like polypeptide as defined hereinabove, an allelic variant being as defined herein.

According to the present invention, there is provided a method for enhancing yield-related traits in plants, comprising introducing and expressing in a plant an allelic variant of any one of the nucleic acids given in Table A of Example 1, or comprising introducing and expressing in a plant an allelic variant of a nucleic acid encoding an orthologue, paralogue or homologue of any of the amino acid sequences given in Table A of Example 1.

The allelic variants useful in the methods of the present invention have substantially the same biological activity as the PATL polypeptide of SEQ ID NO: 2 and any of the amino acids depicted in Table A of Example 1. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant, when used in the construction of a phylogenetic tree, such as the one depicted in FIG. 3, clusters with any of the sequences in the tree, more preferably with the sequences in group Ia which comprises SEQ ID NO: 2.

Other allelic variants useful in the methods of the present invention have substantially the same biological activity as the PRP38 polypeptide of SEQ ID NO: 77 and any of the amino acids depicted in Table A of Example 1. Allelic variants exist in nature, and encompassed within the methods of the present invention is the use of these natural alleles. Preferably, the allelic variant is an allelic variant of SEQ ID NO: 76 or an allelic variant of a nucleic acid encoding an orthologue or paralogue of SEQ ID NO: 77. Preferably, the amino acid sequence encoded by the allelic variant, when used in the construction of a phylogenetic tree, such as the one depicted in FIG. 8, clusters with any of the sequences in group Ib, which comprises SEQ ID NO: 77.

Concerning the GATA-like polypeptides, the allelic variants useful in the methods of the present invention have substantially the same biological activity as the GATA-like polypeptide of SEQ ID NO: 129 and any of the amino acids depicted in Table A of Example 1. Allelic variants exist in nature, and encompassed within the methods of the present invention is the use of these natural alleles.

Preferably, the allelic variant is an allelic variant of SEQ ID NO: 128 or an allelic variant of a nucleic acid encoding an orthologue or paralogue of SEQ ID NO: 129. Preferably, the amino acid sequence encoded by the allelic variant, when used in the construction of a phylogenetic tree, such as the one depicted in FIG. 11 or FIG. 14 in Reyes et al. (2004), clusters with the "Subfamily II" group of GATA-like polypeptides as defined in Reyes et al. (2004), comprising the amino acid sequence represented by SEQ ID NO: 129, rather than with any other group.

Concerning ADA2 polypeptides, the allelic variants useful in the methods of the present invention have substantially the same biological activity as the ADA2 polypeptide of SEQ ID NO: 182 and any of the amino acids depicted in Table A of Example 1. Allelic variants exist in nature, and encompassed within the methods of the present invention is the use of these natural alleles. Preferably, the allelic variant is an allelic variant of SEQ ID NO: 181 or an allelic variant of a nucleic acid encoding an orthologue or paralogue of SEQ ID NO: 182. Preferably, the amino acid sequence encoded by the allelic variant, when used in the construction of a phylogenetic tree, such as the one depicted in FIG. 17, clusters with any of the sequences in the tree, more preferably with the sequences in group Id which comprises SEQ ID NO: 182.

Concerning WDR23-like polypeptides, the allelic variants useful in the methods of the present invention have substantially the same biological activity as the WDR23-like polypeptide of SEQ ID NO: 216 and any of the polypeptide sequences depicted in Table A of Example 1. Allelic variants exist in nature, and encompassed within the methods of the present invention is the use of these natural alleles. Preferably, the allelic variant is an allelic variant of SEQ ID NO: 215 or an allelic variant of a nucleic acid sequence encoding an orthologue or paralogue of SEQ ID NO: 216. Preferably, the allelic variant is an allelic variant of a polypeptide sequence comprising a domain having at least 65%, 70%, 75%, 80%, 85%, 90%, 95%, 98%, 99% or more amino acid sequence identity to a Conserved Domain (CD) as represented by SEQ ID NO: 271.

Gene shuffling or directed evolution may also be used to generate variants of nucleic acids encoding PATL, or PRP38, or GATA-like, or ADA2, or WDR23-like polypeptides as defined above; the term "gene shuffling" being as defined herein.

According to the present invention, there is provided a method for enhancing yield-related traits in plants, comprising introducing and expressing in a plant a variant of any one of the nucleic acid sequences given in Table A of Example 1, or comprising introducing and expressing in a plant a variant of a nucleic acid encoding an orthologue, paralogue or homologue of any of the amino acid sequences given in Table A of Example 1, which variant nucleic acid is obtained by gene shuffling.

Preferably, the amino acid sequence encoded by the variant nucleic acid obtained by gene shuffling, when used in the construction of a phylogenetic tree such as the one depicted in FIG. 3, clusters with any of the sequences in the tree, more preferably with the sequences in group Ia which comprises SEQ ID NO: 2, or SEQ ID NO: 77. Also preferably, the amino acid sequence encoded by the variant nucleic acid obtained by gene shuffling, when used in the construction of a phylogenetic tree such as the one depicted in FIG. 11 or FIG. 14 in Reyes et al. (2004), clusters with the "Subfamily II" group of GATA-like polypeptides as defined in Reyes et al. (2004), comprising the amino acid sequence represented by SEQ ID NO: 129, rather than with any other group. Concerning ADA2, preferably, the amino acid sequence encoded by the variant nucleic acid obtained by gene shuffling, when used in the construction of a phylogenetic tree such as the one depicted in FIG. 17, clusters with any of the sequences in the tree, more preferably with the sequences in group Id which comprises SEQ ID NO: 182. Concerning WDR23, the variant nucleic acid sequence obtained by gene shuffling encodes a polypeptide sequence comprising a domain having at least 65%, 70%, 75%, 80%, 85%, 90%, 95%, 98%, 99% or more amino acid sequence identity to a Conserved Domain (CD) as represented by SEQ ID NO: 271.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding PATL, or PRP38, or GATA-like, or ADA2 polypeptides may be derived from any natural or artificial source. The nucleic acid may be modified from its native form in composition and/or genomic environment through deliberate human manipulation. Preferably the PATL, or the GATA-like polypeptide-encoding nucleic acid is from a plant, further preferably from a monocotyledonous plant, more preferably from the family poaceae, most preferably the nucleic acid is from *Oryza sativa*. Preferably the PRP38 polypeptide-encoding nucleic acid is from a plant, further preferably from a dicotyledonous plant, more preferably from the family brasicaceae, most preferably the nucleic acid is from *Arabidopsis thaliana*. Preferably the ADA2 polypeptide-encoding nucleic acid is from a plant, further preferably from a dicotyledonous plant, more preferably from the family brasicaceae, most preferably the nucleic acid is from *Arabidopsis thaliana*. Nucleic acid sequences encoding WDR23-like polypeptides may be derived from any natural or artificial source. The nucleic acid sequence may be modified from its native form in composition and/or genomic environment through deliberate human manipulation. The nucleic acid sequence encoding a WDR23-like polypeptide is from the Eukaryota domain, preferably from the plant kingdom, further preferably from a dicotyledon plant. More preferably, the nucleic acid sequence encoding a WDR23-like polypeptide is from the Brassicaceae family, most preferably, the nucleic acid sequence is encoding a WDR23-like polypeptide is from *Arabidopsis thaliana*.

Advantageously, the present invention provides hitherto unknown PATL nucleic acids and polypeptide sequences.

According to a further embodiment of the present invention, there is provided an isolated nucleic acid molecule comprising:
(i) a nucleic acid represented by SEQ ID NO: 9; SEQ ID NO: 11; SEQ ID NO: 13; SEQ ID NO: 15; SEQ ID NO: 17; SEQ ID NO: 19; SEQ ID NO: 21; SEQ ID NO: 23; SEQ ID NO: 25 and SEQ ID NO: 27;
(ii) a nucleic acid or fragment thereof that is complementary to any one of the SEQ ID NOs given in (i);
(iii) a nucleic acid encoding a PATL polypeptide having, in increasing order of preference, at least 70%, 75%, 80%, 85%, 90%, 95%, 96%, 97%, 98%, 98% or more sequence identity to any one of the amino acid sequences given in SEQ ID NO: 10; SEQ ID NO: 12; SEQ ID NO: 14; SEQ ID NO: 16; SEQ ID NO: 18; SEQ ID NO: 20; SEQ ID NO: 22; SEQ ID NO: 24; SEQ ID NO: 26 and SEQ ID NO: 28;
(iv) a nucleic acid capable of hybridizing under stringent conditions to any one of the nucleic acids given in (i), (ii) or (iii) above.

According to a further embodiment of the present invention, there is therefore provided an isolated polypeptide comprising:
(i) an amino acid sequence having, in increasing order of preference, at least 80%, 85%, 90%, 95%, 96%, 97%, 98%, 99% or 100% sequence identity to any one of the amino acid sequences given in SEQ ID NO: 10; SEQ ID NO: 12; SEQ ID NO: 14; SEQ ID NO: 16; SEQ ID NO: 18; SEQ ID NO: 20; SEQ ID NO: 22; SEQ ID NO: 24; SEQ ID NO: 26 and SEQ ID NO: 28;
(ii) derivatives of any of the amino acid sequences given in (i).

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid encoding a PATL, or PRP38, or a GATA-like, or ADA2, or a WDR23-like polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding a PATL, or PRP38, or a GATA-like, or ADA2, or a WDR23-like polypeptide as defined herein.

An increase in yield and/or growth rate occurs under typical agricultural growth conditions which comprise the everyday stresses to which plants are exposed. Plants typically respond to exposure to stress by growing more slowly. In conditions of severe stress, the plant may even stop growing altogether. Mild or everyday stresses on the other hand are stresses to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. A plant cultivated under typical agricultural conditions may often encounter mild stresses. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress.

Concerning the GATA-like, an increase in yield and/or growth rate occurs whether the plant is under non-stress conditions or whether the plant is exposed to various stresses compared to control plants. Concerning, WDR23, ncreased yield-related traits occur whether the plant is under non-stress conditions or whether the plant is exposed to various stresses compared to control plants grown under comparable conditions. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. Biotic stresses are typically those stresses caused by pathogens, such as bacteria, viruses, fungi, nematodes, and insects. The term "non-stress" conditions as used herein are those environmental conditions that allow optimal growth of plants. Persons skilled in the art are aware of normal soil conditions and climatic conditions for a given location.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions are those environmental conditions that allow optimal growth of plants. Persons skilled in the art are aware of normal soil conditions and climatic conditions for a given location. The term non-stress conditions as used herein, encompasses the occasional or everyday mild stresses to which a plant is exposed, as defined herein, but does not encompass severe stresses.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a PATL, or PRP38, or a GATA-like, or ADA2, or a WDR23-like polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a PATL, or PRP38, or a GATA-like, or ADA2, or a WDR23-like polypeptide.

Nutrient deficiency may result from a lack of nutrients such as nitrogen, phosphates and other phosphorous-containing compounds, potassium, calcium, cadmium, magnesium, manganese, iron and boron, amongst others. Concerning WDR23, preferably, reduced nutrient availability is reduced nitrogen availability.

The present invention encompasses plants or parts thereof (including seeds) obtainable by the methods according to the present invention. The plants or parts thereof comprise a nucleic acid transgene encoding a PATL, or PRP38, or a GATA-like, or ADA2, or a WDR23-like polypeptide as defined above.

The invention also provides genetic constructs and vectors to facilitate introduction and/or expression in plants of nucleic acids encoding PATL, or PRP38, or a GATA-like, or ADA2, or a WDR23-like polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a PATL, or PRP38, or a GATA-like, or ADA2, or a WDR23-like polypeptide as defined above;
(b) one or more control sequences capable of driving expression of the nucleic acid sequence of (a); and optionally
(c) a transcription termination sequence.

Preferably, the nucleic acid encoding a PATL, or PRP38, or a GATA-like, or ADA2, or a WDR23-like polypeptide is as defined above. The term "control sequence" and "termination sequence" are as defined herein.

Concerning WDR23, preferably, one of the control sequences of a construct is a constitutive promoter isolated from a plant genome. An example of a plant constitutive promoter is a GOS2 promoter, more preferably a rice GOS2 promoter, most preferably a GOS2 promoter as represented by SEQ ID NO: 272. Alternatively, one of the control sequences of a construct is a meristem-specific promoter isolated from a plant genome. An example of a plant meristem-specific promoter is a metallothionein (MT) promoter, more preferably a rice MT promoter, most preferably an MT promoter as represented by SEQ ID NO: 273.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to increase expression of the nucleic acid sequence. A constitutive promoter is particularly useful in the methods. Preferably the constitutive promoter is also a ubiquitous promoter. Concerning the GATA-like polypeptides, the promoter is of medium strength See the "Definitions" section herein for definitions of the various promoter types.

It should be clear that the applicability of the present invention is not restricted to the PATL polypeptide-encoding nucleic acid represented by SEQ ID NO: 1, nor is the applicability of the invention restricted to expression of a PATL polypeptide-encoding nucleic acid when driven by a constitutive promoter, or when driven by a green-tissue promoter.

Furthermore it should be clear that the applicability of the invention is not restricted to the PRP38 polypeptide-encoding nucleic acid represented by SEQ ID NO: 76, nor is the applicability of the invention restricted to expression of a PRP38 polypeptide-encoding nucleic acid when driven by a constitutive promoter, or when driven by a root-specific promoter.

Also, it should be clear that the applicability of the present invention is not restricted to the GATA-like polypeptide-encoding nucleic acid represented by SEQ ID NO: 128, nor is the applicability of the invention restricted to expression of a GATA-like polypeptide-encoding nucleic acid when driven by a constitutive promoter.

Also, it should be clear that the applicability of the present invention is not restricted to the ADA2 polypeptide-encoding nucleic acid represented by SEQ ID NO: 181, nor is the applicability of the invention restricted to expression of an ADA2 polypeptide-encoding nucleic acid when driven by a constitutive promoter, or when driven by a green-tissue promoter.

Also, it should be clear that the applicability of the present invention is not restricted to a nucleic acid sequence encoding the WDR23-like polypeptide, as represented by SEQ ID NO: 215, nor is the applicability of the invention restricted to expression of a WDR23-like polypeptide-encoding nucleic acid sequence when driven by a constitutive or meristem-specific promoter.

The constitutive promoter is preferably a HMG (high mobility group), also called HMGP promoter, preferably a HMG promoter from rice. Further preferably the constitutive promoter is represented by a nucleic acid sequence substantially similar to SEQ ID NO: 33, most preferably the constitutive promoter is as represented by SEQ ID NO: 33. The green tissue specific promoter is preferably a EXP9 (Expansin), also called EXP, also called HMGP promoter, preferably a EXP promoter from rice. Further preferably the green tissue specific is represented by a nucleic acid sequence substantially similar to SEQ ID NO: 34, most preferably the constitutive promoter is as represented by SEQ ID NO: 34. See Table 2 in the "Definitions" section herein for reference describing HMG and EXP promoter and for further examples of constitutive and green tissue specific promoters.

Concerning PRP38, the constitutive promoter is preferably a GOS2 promoter, preferably a GOS2 promoter from rice. Further preferably the constitutive promoter is represented by a nucleic acid sequence substantially similar to SEQ ID NO: 127, most preferably the constitutive promoter is as represented by SEQ ID NO: 127. See Table ii in the "Definitions" section herein for further examples of constitutive promoters.

Concerning the GATA-like polypeptides, the constitutive promoter is preferably a GOS2 promoter, preferably a GOS2 promoter from rice. Further preferably the constitutive promoter is represented by a nucleic acid sequence substantially similar to SEQ ID NO: 135 most preferably the constitutive promoter is as represented by SEQ ID NO: 135. Optionally, one or more terminator sequences may be used in the construct introduced into a plant. Preferably, the construct comprises an expression cassette essentially similar or identical to SEQ ID NO 136, comprising the GOS2 promoter and the nucleic acid encoding the GATA-like polypeptide of SEQ ID NO: 129.

Concerning ADA2 polypeptides, the constitutive promoter is preferably a HMG (high mobility group), also called HMGP promoter, preferably a HMG promoter from rice. Further preferably the constitutive promoter is represented by a nucleic acid sequence substantially similar to SEQ ID NO: 213, most preferably the constitutive promoter is as represented by SEQ ID NO: 213. The green tissue specific promoter is preferably a EXP9 (Expansin), also called EXP, also called HMGP promoter, preferably a EXP promoter from rice. Further preferably the green tissue specific is represented by a nucleic acid sequence substantially similar to SEQ ID NO: 214, most preferably the constitutive promoter is as represented by SEQ ID NO: 214. See Table iii in the "Definitions" section herein for reference describing HMG and EXP promoter and for further examples of constitutive and green tissue specific promoters.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having enhanced yield-related traits relative to control plants, comprising introduction and expression in a plant of any nucleic acid encoding a PATL, or PRP38, or a GATA-like, or ADA2, or a WDR23-like polypeptide as defined hereinabove.

More specifically, the present invention provides a method for the production of transgenic plants having increased enhanced yield-related traits, particularly increased seed yield, which method comprises:
(i) introducing and expressing in a plant or plant cell a PATL, or PRP38, or ADA2 polypeptide-encoding nucleic acid; and
(ii) cultivating the plant cell under conditions promoting plant growth and development, and optionally
(iii) selecting for plants having enhanced yield-related traits Concerning the GATA-like polypeptides, the present invention provides a method for the production of transgenic plants having increased enhanced yield-related traits, particularly increased TKW, which method comprises:
(i) introducing and expressing in a plant or plant cell a GATA-like polypeptide, or a WDR23-like polypeptide-encoding nucleic acid; and
(ii) cultivating the plant cell under conditions promoting plant growth and development.

The nucleic acid of (i) may be any of the nucleic acids capable of encoding a PATL, or PRP38, or a GATA-like, or ADA2, or a WDR23-like polypeptide as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a PATL, or PRP38, or a GATA-like, or ADA2, or a WDR23-like polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum and oats.

The invention also extends to harvestable parts of a plant such as, but not limited to seeds, leaves, fruits, flowers, stems, roots, rhizomes, tubers and bulbs or also to an isolated nucleic acid sequence encoding a WDR23-like (as defined hereinabove) operably linked to a plant constitutive promoter. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding a PATL, or PRP38, or a GATA-like, or ADA2, or a WDR23-like polypeptide is by introducing and expressing in a plant a nucleic acid encoding a PATL, or PRP38, or a GATA-like, or ADA2, or a WDR23-like polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids encoding PATL, or PRP38, or a GATA-like, or ADA2, or a WDR23-like polypeptides as described herein and use of these PATL, or PRP38, or a GATA-like, or ADA2, or a WDR23-like polypeptides in enhancing any of the aforementioned yield-related traits in plants, under normal growth conditions, under abiotic stress growth (preferably osmotic stress growth conditions) conditions, and under growth conditions of reduced nutrient availability, preferably under conditions of reduced nitrogen availability.

Nucleic acids encoding PATL, or PRP38, or a GATA-like, or ADA2, or a WDR23-like polypeptide described herein, or the PATL, or PRP38, or a GATA-like, or ADA2, or a WDR23-like polypeptides themselves, may find use in breeding programmes in which a DNA marker is identified which may be genetically linked to a PATL, or PRP38, or a GATA-like, or ADA2, or a WDR23-like polypeptide-encoding gene. The nucleic acids/genes, or the PATL, or PRP38, or a GATA-like, or ADA2, or a WDR23-like polypeptides themselves may be used to define a molecular marker. This DNA or protein marker may then be used in breeding programmes to select plants having enhanced yield-related traits as defined hereinabove in the methods of the invention.

Allelic variants of a PATL, or PRP38, or a GATA-like, or ADA2, or a WDR23-like polypeptide-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding PATL, or PRP38, or a GATA-like, or ADA2, or a WDR23-like polypeptides may also be used as probes for genetically and physically mapping the genes that they are a part of, and as markers for traits linked to those genes. Such information may be useful in plant breeding in order to develop lines with desired phenotypes. Such use of PATL, or PRP38, or a GATA-like, or ADA2, or a WDR23-like polypeptide-encoding nucleic acids requires only a nucleic acid sequence of at least 15 nucleotides in length. The PATL, or PRP38, or a GATA-like, or ADA2, or a WDR23-like polypeptide-encoding nucleic acids may be used as restriction fragment length polymorphism (RFLP) markers. Southern blots (Sambrook J, Fritsch EF and Maniatis T (1989) Molecular Cloning, A Laboratory Manual) of restriction-digested plant genomic DNA may be probed with the PATL, or PRP38, or GATA-like, or ADA2, or a WDR23-like-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the PATL, or PRP38, or a GATA-like, or ADA2, or a WDR23-like polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

In one embodiment the invention relates to subject mater summarized as follows:

Item 1A A method for enhancing yield-related traits in plants relative to control plants, comprising modulating expression in a plant of a nucleic acid encoding a PATELLIN polypeptide and optionally selecting for plants having enhanced yield-related traits.

Item 2A Method according to item 1A, wherein said PATELLIN polypeptide comprises at least one of the following domains:

(i) A SEC14 domain as represented by SEQ ID NO: 71: lpeldsvvfyrgadreghpvcynvygefqdkdlyekafgdeekrerflkwriqll ergilsqldfspsgicsmvqvtdlknsppmlgk hravtrqavallqdnypefi-akkvfinvpwwylaankmmspfltqrtkskfifaspaksaetlfryiapeqvpv qfgglfk or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 71 or to any SEC14 domain as present in any of the polypeptides of Table A;

(ii) A GOLD domain as represented by SEQ ID NO: 72: sdavteltikpssketveipvtenstig-welrvlgwevsygaeftpdaeg-gytvivqktrkvpaneepimkgsfkvgepgkivltinn paskkkkllyrskv, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 72 or to any GOLD domain as present in any of the polypeptides of Table A.

Item 3A Method according to item 1A or 2A, wherein said modulated expression is effected by introducing and expressing in a plant a nucleic acid encoding a PATELLIN polypeptide.

Item 4A Method according to any preceding item, wherein said nucleic acid encoding a PATELLIN polypeptide encodes any one of the proteins listed in Table A or is a portion of such a nucleic acid, or a nucleic acid capable of hybridising with such a nucleic acid.

Item 5A Method according to any preceding item, wherein said nucleic acid sequence encodes an orthologue or paralogue of any of the proteins given in Table A.

Item 6A Method according to any preceding item, wherein said enhanced yield-related traits comprise increased yield, preferably seed yield relative to control plants.

Item 7A Method according to any one of items 1A to 6A, wherein said enhanced yield-related traits are obtained under conditions of nitrogen deficiency.

Item 8A Method according to any one of items 3A to 7A, wherein said nucleic acid is operably linked to a constitutive promoter, preferably to a GOS2 promoter, most preferably to a GOS2 promoter from rice.

Item 9A Method according to any preceding item, wherein said nucleic acid encoding a PATELLIN polypeptide is of plant origin, preferably from a dicotyledonous plant, further preferably from the family Poaceae, more preferably from the genus *Oryza*, most preferably from *Oryza sativa*.

Item 10A Plant or part thereof, including seeds, obtainable by a method according to any preceding item, wherein said plant or part thereof comprises a recombinant nucleic acid encoding a PATELLIN polypeptide.

Item 11A An isolated nucleic acid molecule comprising any one of the following features:
(i) a nucleic acid represented by SEQ ID NO: 9; SEQ ID NO: 11; SEQ ID NO: 13; SEQ ID NO: 15; SEQ ID NO: 17; SEQ ID NO: 19; SEQ ID NO: 21; SEQ ID NO: 23; SEQ ID NO: 25 and SEQ ID NO: 27;
(ii) a nucleic acid fragment that is complementary to any one of the SEQ ID NOs given in (i);
(iii) a nucleic acid encoding a PATELLIN polypeptide having, in increasing order of preference, at least 70%, 75%, 80%, 85%, 90%, 95%, 96%, 97%, 98%, 99% or 100% sequence identity to any one of the amino acid sequences given in SEQ ID NO: 10; SEQ ID NO: 12; SEQ ID NO: 14; SEQ ID NO: 16; SEQ ID NO: 18; SEQ ID NO: 20; SEQ ID NO: 22; SEQ ID NO: 24; SEQ ID NO: 26 and SEQ ID NO: 28;
(iv) a nucleic acid capable of hybridizing under stringent conditions to any one of the nucleic acids given in (i), (ii) or (iii) above.

Item 12A An isolated polypeptide comprising:
(i) an amino acid sequence having, in increasing order of preference, at least 80%, 85%, 90%, 95%, 96%, 97%, 98%, 99% or 100% sequence identity to any one of the amino acid sequences given in SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24; SEQ ID NO: 26 and SEQ ID NO: 28;
(ii) derivatives of any of the amino acid sequences given in (i).

Item 13A Construct comprising:
(i) nucleic acid encoding a PATELLIN polypeptide as defined in items 1A, 2A or 12A, or a nucleic acid according to item 11;
(ii) one or more control sequences capable of driving expression of the nucleic acid sequence of (a); and optionally
(iii) a transcription termination sequence.

Item 14A Construct according to item 13A, wherein one of said control sequences is a constitutive promoter, preferably a GOS2 promoter, most preferably a GOS2 promoter from rice.

Item 15A Use of a construct according to item 13A or 14A in a method for making plants having increased yield, particularly increased biomass and/or increased seed yield relative to control plants.

Item 16A Plant, plant part or plant cell transformed with a construct according to item 13A or 14A.

Item 17A Method for the production of a transgenic plant having increased yield, preferably increased seed yield relative to control plants, comprising:
(i) introducing and expressing in a plant a nucleic acid encoding a PATELLIN polypeptide as defined in item 1A, 2A or 12A, or a nucleic acid according to item 11A; and
(ii) cultivating the plant cell under conditions promoting plant growth and development; and optionally
(iii) selecting for plants having enhanced yield-related traits Item 18A Transgenic plant having increased yield, particularly increased seed yield, relative to control plants, resulting from modulated expression of a nucleic acid encoding a PATELLIN polypeptide as defined in item 1A or 2A, or a transgenic plant cell derived from said transgenic plant.

Item 19A Transgenic plant according to item 11A, 16A or 18A, or a transgenic plant cell derived thereof, wherein said plant is a crop plant or a monocot or a cereal, such as rice, maize, wheat, barley, millet, rye, triticale, sorghum and oats.

Item 20A Harvestable parts of a plant according to item 19A, wherein said harvestable parts are preferably shoot biomass and/or seeds.

Item 21A Products derived from a plant according to item 19A and/or from harvestable parts of a plant according to item 20A.

Item 22A Use of a nucleic acid encoding a PATELLIN polypeptide in increasing yield, particularly in increasing seed yield and/or shoot biomass in plants, relative to control plants.

Item 1B A method for enhancing yield-related traits in plants relative to control plants, comprising modulating expression in a plant of a nucleic acid encoding a PRP38 polypeptide.

Item 2B Method according to item 1B, wherein said PRP38 polypeptide comprises one or more of the following motifs:
(i) A DUF1777 domain
(ii) An RS domain
(iii) Motif 1a (SEQ ID NO: 120) wherein any amino acid residue may be substituted by a conservative amino acid and/or up to 50% of the amino acid residues may be substituted by a non conservative amino acid.
(iv) Motif 1a (SEQ ID NO: 121) wherein any amino acid residue may be substituted by a conservative amino acid and/or up to 50% of the amino acid residues may be substituted by a non conservative amino acid.
(v) Motif 1a (SEQ ID NO: 122) wherein any amino acid residue may be substituted by a conservative amino acid and/or up to 50% of the amino acid residues may be substituted by a non conservative amino acid.

Item 3B Method according to item 1B or 2B, wherein said modulated expression is effected by introducing and expressing in a plant a nucleic acid encoding a PRP38 polypeptide.

Item 4B Method according to any preceding item, wherein said nucleic acid encoding a PRP38 polypeptide encodes any one of the proteins listed in Table A or is a portion of such a nucleic acid, or a nucleic acid capable of hybridising with such a nucleic acid.

Item 5B Method according to any preceding item, wherein said nucleic acid sequence encodes an orthologue or paralogue of any of the proteins given in Table A.

Item 6B Method according to any preceding item, wherein said enhanced yield-related traits comprise increased yield, preferably increased biomass and/or increased seed yield relative to control plants.

Item 7B Method according to any one of items 1B to 6B, wherein said enhanced yield-related traits are obtained under non-stress conditions.

Item 8B Method according to any one of items 1B to 6B, wherein said enhanced yield-related traits are obtained under conditions of nitrogen deficiency.

Item 9B Method according to any one of items 3B to 8B, wherein said nucleic acid is operably linked to a constitutive promoter, preferably to a GOS2 promoter, most preferably to a GOS2 promoter from rice.

Item 10B Method according to any preceding item, wherein said nucleic acid encoding a PRP38 polypeptide is of plant origin, preferably from a dicotyledonous plant, further preferably from the family Brassicaceae, more preferably from the genus *Arabidopsis*, most preferably from *Arabidopsis thaliana*.

Item 11B Plant or part thereof, including seeds, obtainable by a method according to any preceding item, wherein said plant or part thereof comprises a recombinant nucleic acid encoding a PRP38 polypeptide.

Item 12B Construct comprising:
(i) nucleic acid encoding a PRP38 polypeptide as defined in items 1 or 2;
(ii) one or more control sequences capable of driving expression of the nucleic acid sequence of (a); and optionally
(iii) a transcription termination sequence.

Item 13B Construct according to item 12B wherein one of said control sequences is a constitutive promoter, preferably a GOS2 promoter, most preferably a GOS2 promoter from rice.

Item 14B Use of a construct according to item 12B or 13B in a method for making plants having increased yield, particularly increased biomass and/or increased seed yield relative to control plants.

Item 15B Plant, plant part or plant cell transformed with a construct according to item 12B or 13B.

Item 16B Method for the production of a transgenic plant having increased yield, particularly increased biomass and/or increased seed yield relative to control plants, comprising:
(i) introducing and expressing in a plant a nucleic acid encoding a PRP38 polypeptide as defined in item 1B or 2B; and
(ii) cultivating the plant cell under conditions promoting plant growth and development.

Item 17B Transgenic plant having increased yield, particularly increased biomass and/or increased seed yield, relative to control plants, resulting from modulated expression of a nucleic acid encoding a PRP38 polypeptide as defined in item 1B or 2B, or a transgenic plant cell derived from said transgenic plant.

Item 18B Transgenic plant according to item 11B, 15B or 17B, or a transgenic plant cell derived thereof, wherein said plant is a crop plant or a monocot or a cereal, such as rice, maize, wheat, barley, millet, rye, triticale, sorghum and oats.

Item 19B Harvestable parts of a plant according to item 18B, wherein said harvestable parts are preferably shoot biomass and/or seeds.

Item 20B Products derived from a plant according to item 18B and/or from harvestable parts of a plant according to item 19B.

Item 21B Use of a nucleic acid encoding a PRP38 polypeptide in increasing yield, particularly in increasing seed yield and/or shoot biomass in plants, relative to control plants.

Item 10A method for increasing one or more of Thousand Kernel Weight, total weight of seeds and number of filled seeds in plants relative to control plants, comprising modulating expression in a plant of a nucleic acid encoding a GATA-like polypeptide, wherein said GATA-like polypeptide belongs to subfamily II of GATA transcription factors and comprises a GATA domain.

Item 2C Method according to item 1C, wherein said GATA-like polypeptide comprises one or more of the following motifs:

(i) Motif 1c: (SEQ ID NO: 130)
C(S/A/T)(D/E/N)CXT(T/S/A)(K/S)TP(L/M)WR(S/G/N)GP, (ii) Motif 2c: (SEQ ID NO: 131)
GPKSLCNACGIRX(R/K)K, (iii) Motif 3c: (SEQ ID NO: 132)
(A/S)(A/W)X(L/C)(L/N)(M/L/V)(T/L/A)(L/D)(S/R)

Item 3C Method according to item 1C or 2C, wherein said modulated expression is effected by introducing and expressing in a plant a nucleic acid encoding a GATA-like polypeptide.

Item 4C Method according to any preceding item, wherein said nucleic acid encoding a GATA-like polypeptide encodes any one of the proteins listed in Table A or is a portion of such a nucleic acid, or a nucleic acid capable of hybridising with such a nucleic acid.

Item 5C Method according to any preceding item, wherein said nucleic acid sequence encodes an orthologue or paralogue of any of the proteins given in Table A.

Item 6C Method according to any one of items 10 to 5C, wherein said enhanced yield-related traits are obtained under non-stress conditions.

Item 7C Method according to any one of items 3C to 6C, wherein said nucleic acid is operably linked to a constitutive promoter, preferably to a GOS2 promoter, most preferably to a GOS2 promoter from rice.

Item 8C Method according to any preceding item, wherein said nucleic acid encoding a GATA-like polypeptide is of plant origin, preferably from a monocotyledonous plant, further preferably from the family Poaceae, more preferably from the genus *Oryza*, most preferably from *Oryza sativa*.

Item 9C Plant or part thereof, including seeds, obtainable by a method according to any preceding item, wherein said plant or part thereof comprises a recombinant nucleic acid encoding a GATA-like polypeptide operably linked to constitutive promoter of plant origin, preferably a GOS2 promoter, more preferably a GOS2 promoter from rice.

Item 10C Construct comprising:
(i) nucleic acid encoding a GATA-like polypeptide as defined in items 10 or 2C;
(ii) one or more control sequences of plant origin capable of driving expression of the nucleic acid sequence of (a); and optionally
(iii) a transcription termination sequence.

Item 11C Construct according to item 1CC, wherein one of said control sequences is a constitutive promoter, preferably a GOS2 promoter, most preferably a GOS2 promoter from rice.

Item 12C Use of a construct according to item 1CCor 11C in a method for making plants having increased seed yield, comprising one or more of Thousand Kernel Weight, total weight of seeds and number of filled seeds, relative to control plants.

Item 13C Plant, plant part or plant cell transformed with a construct according to item 10C or 11C.

Item 14C Method for the production of a transgenic plant having increased yield, particularly increased biomass and/or increased seed yield relative to control plants, comprising:
(i) introducing and expressing in a plant a nucleic acid encoding a GATA-like polypeptide as defined in item 1C or 2C and operably linked to a constitutive promoter of plant origin; and
(ii) cultivating the plant cell under conditions promoting plant growth and development.

Item 15C Transgenic plant having increased Thousand Kernel Weight, relative to control plants, resulting from modulated expression of a nucleic acid encoding a GATA-like polypeptide as defined in item 1C or 2C, or a transgenic plant cell derived from said transgenic plant.

Item 16C Transgenic plant according to item 9C, 13C or 15C, or a transgenic plant cell derived thereof, wherein said plant is a crop plant or a monocot or a cereal, such as rice, maize, wheat, barley, millet, rye, triticale, sorghum and oats.

Item 17C Harvestable parts of a plant according to item 17C, wherein said harvestable parts are preferably seeds.

Item 18C Products derived from a plant according to item 16C and/or from harvestable parts of a plant according to item 17C.

Item 19C Use of a nucleic acid encoding a GATA-like polypeptide in increasing one or more of Thousand Kernel Weight, total weight of seeds and number of filled seeds in plants, relative to control plants.

Item 1D A method for enhancing yield-related traits in plants relative to control plants, comprising modulating expression in a plant of a nucleic acid encoding an ADA2 polypeptide and optionally selecting for plants having enhanced yield-related traits.

Item 2D Method according to item 1 D, wherein said ADA2 polypeptide comprises two or more of the following motifs:
(i) A Zinc (Zn) finger ZZ type domain as represented by SEQ ID NO: 207: kpglyccnycdkdlsglvrfkcavcmd-fdlcvecfsvgvelnrhkn or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 207 or to any Zn finger ZZ type domain as present in any one of the polypeptides of Table A;
(ii) A SANT DNA binding domain as represented by SEQ ID NO: 208: vtsdwnadeeillleaiatygfgnwke-vadhvgsktttecikhfnsaym, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 208 or to any SANT domain as present in any one of the polypeptides of Table A;
(iii) A Ca binding EF hand domain as represented by SEQ ID NO: 209: dndaeqlladmef, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 209 or to any Ca binding EF hand domain as present in any one of the polypeptides of Table A;
(iv) A SWIRM domain as represented by SEQ ID NO: 210: priysgldtwdvdgllgadllsetekkm-cnetrilpvhylkmldiltreikkg-qikkksdaysffkvepskvdrvydmlvhkgigdst, or a domain having in increasing order of preference at least 50%, 55%, 60%, 65%, 70%, 75%, 80%, 82%, 85%, 90%, 92%, 95%, 97% or more sequence identity to the domain represented by SEQ ID NO: 210 or to any SWRIM domain as present in any one of the polypeptides of Table A;

Item 3D Method according to item 1D or 2D, wherein said modulated expression is effected by introducing and expressing in a plant a nucleic acid encoding an ADA2 polypeptide.

Item 4D Method according to any preceding item, wherein said nucleic acid encoding an ADA2 polypeptide encodes any one of the proteins listed in Table A or is a portion of such a nucleic acid, or a nucleic acid capable of hybridising with such a nucleic acid.

Item 5D Method according to any preceding item, wherein said nucleic acid sequence encodes an orthologue or paralogue of any of the proteins given in Table A.

Item 6D Method according to any preceding item, wherein said enhanced yield-related traits comprise increased yield, preferably seed yield relative to control plants.

Item 7D Method according to any one of items 1D to 6D, wherein said enhanced yield-related traits are obtained under mild-stress conditions.

Item 8D Method according to any one of items 1D to 6D, wherein said enhanced yield-related traits are obtained under conditions of nitrogen deficiency.

Item 9D Method according to any one of items 3D to 8D, wherein said nucleic acid is operably linked to a constitutive promoter, preferably to a HMGP promoter, most preferably to a HMGP promoter from rice.

Item 10D Method according to any preceding item, wherein said nucleic acid encoding an ADA2 polypeptide is of plant origin, preferably from a dicotyledonous plant, further preferably from the family Brassicaceae, more preferably from the genus *Arabidopsis*, most preferably from *Arabidopsis thaliana*.

Item 11D Plant or part thereof, including seeds, obtainable by a method according to any preceding item, wherein said plant or part thereof comprises a recombinant nucleic acid encoding an ADA2 polypeptide.

Item 12D Construct comprising:
(i) nucleic acid encoding an ADA2 polypeptide as defined in items 1D or 2D;
(ii) one or more control sequences capable of driving expression of the nucleic acid sequence of (a); and optionally
(iii) a transcription termination sequence.

Item 13D Construct according to item 12D, wherein one of said control sequences is a constitutive promoter, preferably a HMGP promoter, most preferably a HMGP promoter from rice.

Item 14D Use of a construct according to item 12D or 13D in a method for making plants having increased yield, particularly increased biomass and/or increased seed yield relative to control plants.

Item 15D Plant, plant part or plant cell transformed with a construct according to item 12D or 13D.

Item 16D Method for the production of a transgenic plant having increased yield, particularly increased seed yield relative to control plants, comprising:
(i) introducing and expressing in a plant a nucleic acid encoding an ADA2 polypeptide as defined in item 1D or 2D; and
(ii) cultivating the plant cell under conditions promoting plant growth and development; and optionally
(iii) selecting for plants having enhanced yield-related traits Item 17D Transgenic plant having increased yield, particularly increased seed yield, relative to control plants, resulting from modulated expression of a nucleic acid encoding an ADA2 polypeptide as defined in item 1D or 2D, or a transgenic plant cell derived from said transgenic plant.

Item 18D Transgenic plant according to item 11D, 15D or 17D, or a transgenic plant cell derived thereof, wherein said plant is a crop plant or a monocot or a cereal, such as rice, maize, wheat, barley, millet, rye, triticale, sorghum and oats.

Item 19D Harvestable parts of a plant according to item 19, wherein said harvestable parts are preferably shoot biomass and/or seeds.

Item 20D Products derived from a plant according to item 18D and/or from harvestable parts of a plant according to item 19D.

Item 21D Use of a nucleic acid encoding an ADA2 polypeptide in increasing yield, particularly in increasing seed yield and/or shoot biomass in plants, relative to control plants.

Item 1E An isolated nucleic acid sequence encoding a WD40 repeat (WDR) 23-like polypeptide comprising:
(i) an isolated nucleic acid sequence as represented by SEQ ID NO: 219, SEQ ID NO: 225, or SEQ ID NO: 229;
(ii) the complement of an isolated nucleic acid sequence as represented by SEQ ID NO: 219, SEQ ID NO: 225, or SEQ ID NO: 229;
(iii) an isolated nucleic acid sequence encoding a polypeptide sequence as represented by SEQ ID NO: 220, SEQ ID NO: 226, or SEQ ID NO: 230;
(iv) an isolated nucleic acid sequence deduced from a polypeptide sequence as represented by SEQ ID NO: 220, SEQ ID NO: 226, or SEQ ID NO: 230, as a result of the degeneracy of the genetic code;

(v) an isolated nucleic acid sequence capable of stringently hybridising to a nucleic acid sequence as represented by SEQ ID NO: 219, SEQ ID NO: 225, or SEQ ID NO: 229, or to its complement;
(vi) an isolated nucleic acid sequence which encodes a polypeptide having in increasing order %, 55%, 60%, 65%, 70%, 75%, 80%, 85%, 90%, 95%, 96%, 97%, 98%, 99% or more amino acid sequence identity with a polypeptide sequence as represented by SEQ ID NO: 220, SEQ ID NO: 226, or SEQ ID NO: 230;
(vii) an isolated nucleic acid sequence which encodes a polypeptide comprising a domain having, in increasing order of preference, at least 65%, 70%, 75%, 80%, 85%, 90%, 95%, 96%, 97%, 98%, 99% or more amino acid sequence identity with a Conserved Domain as represented by SEQ ID NO: 271.

Item 2E An isolated WDR23-like polypeptide comprising:
(i) a polypeptide sequence as represented by SEQ ID NO: 220, SEQ ID NO: 226, or SEQ ID NO: 230;
(ii) a polypeptide sequence having, in increasing order of preference, at least 50%, 55%, 60%, 65%, 70%, 75%, 80%, 85%, 90%, 95%, 96%, 97%, 98%, 99% amino acid sequence identity with a polypeptide sequence as represented by SEQ ID NO: 220, SEQ ID NO: 226, or SEQ ID NO: 230;
(i) a polypeptide comprising a domain having, in increasing order of preference, at least 65%, 70%, 75%, 80%, 85%, 90%, 95%, 96%, 97%, 98%, 99% or more amino acid sequence identity with a Conserved Domain as represented by SEQ ID NO: 271;
(ii) derivatives of any of the polypeptide sequences given in (i) to (iii) above.

Item 3E A method for increasing yield-related traits in plants relative to control plants, comprising increasing expression in a plant of a nucleic acid sequence encoding a WDR23-like polypeptide, which WDR23-like polypeptide comprises a domain having at least 65%, 70%, 75%, 80%, 85%, 90%, 95%, 98%, 99% or more amino acid sequence identity to a Conserved Domain (CD) as represented by SEQ ID NO: 271, and optionally selecting for plants having increased yield-related traits.

Item 4E Method according to item 3E, wherein said WDR23-like polypeptide comprises: (i) at least four WD40 repeats with a PFAM accession PF00400; and (ii) at least two conserved D×R motifs at the end of two consecutive WD40 repeats.

Item 5E Method according to item 3E or 4E, wherein said WDR23-like polypeptide has, in increasing order of preference, at least 50%, 55%, 60%, 65%, 70%, 75%, 80%, 85%, 90%, 95%, 98%, 99% or more amino acid sequence identity to the WDR23-like polypeptide as represented by SEQ ID NO: 216, or to any of the polypeptide sequences given in Table A herein, or to a WDR23-like polypeptide as defined in item 2E.

Item 6E Method according to any one of items 3E to 5E, wherein said nucleic acid sequence encoding a WDR23-like polypeptide is represented by any one of the nucleic acid sequence SEQ ID NOs given in Table A or a portion thereof, or a sequence capable of hybridising with any one of the nucleic acid sequences SEQ ID NOs given in Table A.

Item 7E Method according to any one of imtes 3E to 6E, wherein said nucleic acid sequence encodes an orthologue or paralogue of any of the polypeptide sequence SEQ ID NOs given in Table A.

Item 8E Method according to any one of items 3E to 7E, wherein said increased expression is effected by any one or more of: T-DNA activation tagging, TILLING, or homologous recombination.

Item 9E Method according to any one of items 3E to 8E, wherein said increased expression is effected by introducing and expressing in a plant a nucleic acid sequence encoding a WDR23-like polypeptide.

Item 10E Method according to any one of items 3E to 9E, wherein said increased yield-related trait is one or more of: increased total seed yield per plant, increased seed filling rate, increased number of filled seeds, increased harvest index, or increased thousand kernel weight.

Item 11E Method according to any one of items 3E to 10E, wherein said nucleic acid sequence is operably linked to a constitutive promoter, preferably to a plant constitutive promoter, more preferably to a GOS2 promoter, most preferably to a GOS2 promoter from rice as represented by SEQ ID NO: 272.

Item 12E Method according to any one of items 3E to 10E, wherein said nucleic acid sequence is operably linked to a meristem-specific promoter, preferably to a plant metallothionein promoter, more preferably to a metallothionein promoter from rice as represented by SEQ ID NO: 273.

Item 13E Method according to any one of items 3E to 12E, wherein said nucleic acid sequence encoding a WDR23-like polypeptide is from the plant kingdom, preferably from a dicotyledonous plant, more preferably from the Brassicaceae family, most preferably from *Arabidopsis thaliana*.

Item 14E Plants, parts thereof (including seeds), or plant cells obtainable by a method according to any one of items 3E to 13E, wherein said plant, part or cell thereof comprises an isolated nucleic acid transgene encoding a WDR23-like polypeptide operably linked to a plant constitutive promoter.

Item 15E Plants, parts thereof (including seeds), or plant cells comprising an isolated nucleic acid transgene according to item 1E, or comprising an isolated nucleic acid sequence encoding a WDR23-like polypeptide according to item 2E.

Item 16E Construct comprising:
(a) a nucleic acid sequence encoding a WDR23-like polypeptide as defined in any one of items 1E, 2E, or 3E to 7E;
(b) one or more control sequences capable of driving expression of the nucleic acid sequence of (a); and optionally
(c) transcription termination sequence.

Item 17E Construct according to item 16E, wherein said control sequence is a plant constitutive promoter, preferably a GOS2 promoter, more preferably a rice GOS2 promoter, most preferably a GOS2 promoter as represented by SEQ ID NO: 272.

Item 18E Construct according to item 16E, wherein said control sequence is a meristem-specific promoter, preferably a metallothionein (MT) promoter, more preferably a rice MT promoter, most preferably an MT promoter as represented by SEQ ID NO: 273.

Item 19E Use of a construct according any one of items 16E to 18E in a method for making plants having increased yield-related traits relative to control plants, which increased yield-related traits are one or more of: increased total seed yield per plant, increased seed filling rate, increased number of filled seeds, increased harvest index, or increased thousand kernel weight.

Item 20E Plant, plant part or plant cell transformed with a construct according to any one of items 16E to 18E.

Item 21E Method for the production of transgenic plants having increased yield-related traits relative to control plants, comprising:
(i) introducing and expressing in a plant, plant part, or plant cell, a nucleic acid sequence encoding a WDR23-like polypeptide as defined in any one of items 1 E or 3E to 7E; and
(ii) cultivating the plant cell, plant part, or plant under conditions promoting plant growth and development.

Item 22E Transgenic plant having increased yield-related traits relative to control plants, resulting from increased expression of a nucleic acid sequence encoding a WDR23-like polypeptide as defined in any one of items 1E, 3E to 7E, operably linked to a plant expressible promoter, or a transgenic plant cell or transgenic plant part derived from said transgenic plant.

Item 23E Transgenic plant according to item 14E, 15E, 20E or 22E, wherein said plant is a crop plant or a monocot or a cereal, such as rice, maize, wheat, barley, millet, rye, triticale, sorghum and oats, or a transgenic plant cell derived from said transgenic plant.

Item 24E Harvestable parts of a plant according to item 23E, comprising an isolated nucleic acid sequence encoding a WDR23-like polypeptide, wherein said harvestable parts are preferably seeds.

Item 25E Products derived from a plant according to item 23E and/or from harvestable parts of a plant according to item 24E.

Item 26E Use of a nucleic acid sequence encoding a WDR23-like polypeptide as defined in any one of items 1E, 3E to 7E in increasing yield-related traits, comprising one or more of: increased total seed yield per plant, increased seed filling rate, increased number of filled seeds, increased harvest index, or increased thousand kernel weight.

DESCRIPTION OF FIGURES

The present invention will now be described with reference to the following figures in which:

FIG. 1 represents the sequence of SEQ ID NO: 2. Domain structure and functionally relevant amino acids are highlighted. SEC14 and GOLD domains are indicated in bold and doubled underlined respectively. Amino acid residues involved in PtdIns/PtdChs binding/transfer activity are boxed, while hydrophobic residues that line the lipid-binding pocket are underlined. Salt bridge domain is shown in lower-case characters. Coiled coil region is underlined with a curly line.

FIG. 2 represents a multiple alignment of a selection of PALT polypeptides of Table A1. Sequences shown are: Arath_PATL1_1 (SEQ ID NO: 40); Arath_PATL1_3 (SEQ ID NO: 44); Arath_PATL1_2 (SEQ ID NO: 42); Brana_PATL_1 (SEQ ID NO: 10); Arath_PATL1_6 (SEQ ID NO: 50); Helan_PATL_1 (SEQ ID NO: 12); Glyma_PATL_3 (SEQ ID NO: 24); Arath_PATL1_4 (SEQ ID NO: 46); Orysa_PATL1_2 (SEQ ID NO: 4); Zeama_PATL_1 (SEQ ID NO: 14); Arath_PATL1_5 (SEQ ID NO: 48); Orysa_PATL1_4 (SEQ ID NO: 8); Orysa_PATL1_1 (SEQ ID NO: 2); Zeama_PATL_3 (SEQ ID NO: 276); Triae_PATL_2 (SEQ ID NO: 18); Orysa_PATL1_3 (SEQ ID NO: 6); Triae_PATL_3 (SEQ ID NO: 20); Zeama_PATL_2 (SEQ ID NO: 26); Glyma_PATL_1 (SEQ ID NO: 16); Glyma_PATL_2 (SEQ ID NO: 22); and Consensus (SEQ ID NO: 277).

FIG. 5 details examples of sequences useful in performing the methods according to the present invention.

FIG. 6 represents the sequence of SEQ ID NO: 77. Conserved domains and motifs are indicated: PRP38 domain is underlined, DUF1777 domain is in bold characters, Motifs Ib, IIb, Mb and IVb are boxed.

FIG. 7 represents a multiple alignment of the PRP38 polypeptides of Table A2. Sequences shown are: Arath_PRP38_1 (SEQ ID NO: 77); Lyces_PRP38_1 (SEQ ID NO: 95); Poptr_PRP38_1 (SEQ ID NO: 107); Poptr_PRP38_2 (SEQ ID NO: 109); Brasy_PRP38_1 (SEQ ID NO: 87); Sacof_PRP38_1 (SEQ ID NO: 111); Sacof_PRP38_3 (SEQ ID NO: 113); Brasy_PRP38_2 (SEQ ID NO: 89); Horvu_PRP38_1 (SEQ ID NO: 93); Orysa_PRP38_1 (SEQ ID NO: 99); Chire_PRP38_1 (SEQ ID NO: 91); Ostta_PRP38_2 (SEQ ID NO: 105); Arath_PRP38_5 (SEQ ID NO: 85); Medtr_PRP38_1 (SEQ ID NO: 97); Vitvi_PRP38_1 (SEQ ID NO: 119); Orysa_PRP38_2 (SEQ ID NO: 101); Triae_PRP38_1 (SEQ ID NO: 117); Ostta_PRP38_1 (SEQ ID NO: 103); Schce_PRP38_1 (SEQ ID NO: 115); and Consensus (SEQ ID NO: 278).

FIG. 10 details examples of sequences useful in performing the methods according to the present invention.

FIG. 11 represents the domain structure of SEQ ID NO: 129 with the GATA domain in bold and the conserved motifs 1c to 3c underlined.

FIG. 12 represents a multiple alignment of Subgroup II GATA-like polypeptides. The dots indicate conserved residues, the colons indicate highly conserved residues and the asterisks indicate identical amino acids. Sequences shown are: GATAp (SEQ ID NO: 129); A2X2I3 (SEQ ID NO: 138); A3A4M7 (SEQ ID NO: 140); A3BCY3 (SEQ ID NO: 142); A2YE96 (SEQ ID NO: 144); Q5Z624 (SEQ ID NO: 146); Q8LC59 (SEQ ID NO: 148); AAB61058 (SEQ ID NO: 150); ABK28715 (SEQ ID NO: 152); AAM63829 (SEQ ID NO: 154); Q1EBW4 (SEQ ID NO: 156); AAL38250 (SEQ ID NO: 158); CAB79470 (SEQ ID NO: 160); CAN63090 (SEQ ID NO: 162); CA065359 (SEQ ID NO: 164); AOJPW8 (SEQ ID NO: 166); CA044870 (SEQ ID NO: 168); A5BCR3 (SEQ ID NO: 170); A2XNM3 (SEQ ID NO: 172); Q5JNB8 (SEQ ID NO: 174); and Q8LC79 (SEQ ID NO: 176).

FIG. 14 details examples of sequences useful in performing the methods according to the present invention.

FIG. 15 represents the sequence of SEQ ID NO: 182. Conserved domains and motifs are indicated. A "KRKK" putative nuclear localization signal is boxed, a Zinc Finger ZZ type domain is highlighted in bold, SANT DNA binding domain is underlined and in bold characters, a Ca binding EF hand domain is indicated in italics and underlined and the SWIRM domain is underlined with a double line. Relevant Lys (K) residue in the central part of the protein and putatively mediating acetylation of ADA2 is boxed.

FIG. 16 represents a multiple alignment of the ADA2 polypeptides of Table A4. Sequences shown are: Arath_ADA2_1 (SEQ ID NO: 182); Dicdi_ADA2_1 (SEQ ID NO: 186); Ostlu_ADA2_1 (SEQ ID NO: 192); Arath_ADA2_2 (SEQ ID NO: 184); Poptr_ADA2_1 (SEQ ID NO: 196); Poptr_ADA2_3 (SEQ ID NO: 200); Lyces_ADA2_2 (SEQ ID NO: 190); Orysa_ADA2_1 (SEQ ID NO: 194); Zeama_ADA2_1 (SEQ ID NO: 204); Zeama_ADA2_2 SEQ ID NO: 206); Lyces_ADA2_1 (SEQ ID NO: 188); Poptr_ADA2_2 (SEQ ID NO: 198); Vitvi_ADA2_1 (SEQ ID NO: 202); and Consensus (SEQ ID NO: 279).

FIG. 20 details examples of sequences useful in performing the methods according to the present invention.

FIG. 21 represents a cartoon of the structure of a WRD23-like as represented by SEQ ID NO: 216. The WD40 repeats corresponding to PFAM accession PF00400 are schematically represented.

FIG. 22 shows the function of the WRD23 in *Homo sapiens*. WRD23 is part of a multiprotein ubiquitin E3 ligase complex of which Cullin 4 (CUL4) and damaged DNA binding protein 1 (DDB1) are the core proteins (Higa et al. (2007) Cell Division 2:5; Angers et al. (2006) Nature 443: 590-593; Higa et al. (2006) Nature Cell Biol 8(11): 1277-1283; He et al. (2006) Genes & Development 20: 2949-2954). This complex docks WD40 proteins, such as WRD23, as molecular adaptors for substrate recruiting mechanism, which substrate will subsequently be ubiquitinated and destroyed.

FIG. 23 shows a sequence alignment representing the DxR motifs conserved in two consecutive blades of the WD40, in the WRD23 from *Homo sapiens* (NCBI accession AK057636), *Aspergillus niger* (NCBI accession CAK40817) and the plant WRD23-like polypeptides of Table A5. Sequences shown are found within the listed SEQ ID NO. BLADE i: Glyma_WDR23 LIKE (SEQ ID NO: 222); Pruar_WDR23 LIKE (SEQ ID NO: 244); Horvu_WDR23 LIKE II (SEQ ID NO: 228); Triae_WDR23 LIKE II (SEQ ID NO: 250); Sacof_WDR23 LIKE II (SEQ ID NO: 246); Zeama_WDR23 LIKE (SEQ ID NO: 256); Orysa_WDR23 LIKE (SEQ ID NO: 238); Triae_WDR23 LIKE (SEQ ID NO: 248); Zeama_WDR23 LIKE (SEQ ID NO: 254); Helan_WDR23 LIKE (SEQ ID NO: 226); Lyces_WDR23 LIKE (SEQ ID NO: 234); Liter_WDR23 LIKE (SEQ ID NO: 232); Glyma_WDR23 LIKE II (SEQ ID NO: 260); Medtr_WDR23 LIKE (SEQ ID NO: 236); Arath_WDR23 LIKE (SEQ ID NO: 216); Linus_WDR23 LIKE (SEQ ID NO: 230); Vitis_WDR23 LIKE (SEQ ID NO: 252); Pinra_WDR23 LIKE (SEQ ID NO: 240); Aqufo_WDR23 LIKE (SEQ ID NO: 218); Poptr_WDR23 LIKE (SEQ ID NO: 242); Homsa_WDR23 SEQ ID NO: 280; Aspn_LEC14B (SEQ ID NO: 282); and Consensus (SEQ ID NO: 284). BLADE i+1: Glyma_WDR23 LIKE (SEQ ID NO: 222); Pruar_WDR23 LIKE (SEQ ID NO: 244); Horvu_WDR23 LIKE II (SEQ ID NO: 228); Triae_WDR23 LIKE II (SEQ ID NO: 250); Sacof_WDR23 LIKE II (SEQ ID NO: 246); Zeama_WDR23 LIKE II (SEQ ID NO: 256); Orysa_WDR23 LIKE (SEQ ID NO: 238); Triae_WDR23 LIKE (SEQ ID NO: 248); Zeama_WDR23 LIKE (SEQ ID NO: 254); Helan_WDR23 LIKE (SEQ ID NO: 226); Lyces_WDR23 LIKE (SEQ ID NO: 234); Liter_WDR23 LIKE (SEQ ID NO: 232); Glyma_WDR23 LIKE II (SEQ ID NO: 260); Medtr_WDR23 LIKE (SEQ ID NO: 236); Arath_WDR23 LIKE (SEQ ID NO: 216); Linus_WDR23 LIKE (SEQ ID NO: 230); Vitis_WDR23 LIKE (SEQ ID NO: 252); Pinra_WDR23 LIKE (SEQ ID NO: 240); Aqufo_WDR23 LIKE (SEQ ID NO: 218); Poptr_WDR23 LIKE (SEQ ID NO: 242); Homsa_WDR23 (SEQ ID NO: 280); Aspn_LEC14B (SEQ ID NO: 282); Homsa_WDR23 (SEQ ID NO: 281); Aspn_LEC14B (SEQ ID NO: 283); and Consensus (SEQ ID NO: 284).

FIG. 24 shows an AlignX (from Vector NTI 10.3, Invitrogen Corporation) multiple sequence alignment of the WDR23-like polypeptides from Table A5. The beginning and the end of the Conserved Domain (CD), for example as represented by SEQ ID NO: 271, is shown using brackets. The WD40 repeats corresponding to PF00400 are marked by X's under the consensus sequence. The DxR motifs are also identified under the consensus sequence. Sequences shown are Aqufo_WDR23 (SEQ ID NO: 218); Brana_WDR23 (SEQ ID NO: 220); Arath_WDR23 (SEQ ID NO: 216); Helan_WDR23 (SEQ ID NO: 226); Linus_WDR23 (SEQ ID NO: 230); Liter_WDR23 (SEQ ID NO: 232); Lyces_WDR23 (SEQ ID NO: 234); Medtr_WDR23 (SEQ ID NO: 236); Orysa_WDR23 (SEQ ID NO: 238); Pinra_WDR23 (SEQ ID NO: 240); Poptr_WDR23 (SEQ ID NO: 242); Triae_WDR23 (SEQ ID NO: 248); Vitis_WDR23 (SEQ ID NO: 252); Zeama_WDR23 (SEQ ID NO: 254); Glyma_WDR23 (SEQ ID NO: 260); Horvu_WDR23 II (SEQ ID NO: 228); Pruar_WDR23 (SEQ ID NO: 244); Sacof_WDR23 II (SEQ ID NO: 246); Triae_WDR23 II (SEQ ID NO: 250); Zeama_WDR23 II (SEQ ID NO: 246); and Consensus (SEQ ID NO: 285).

FIG. 26 details examples of sequences useful in performing the methods according to the present invention.

EXAMPLES

Figure 3:
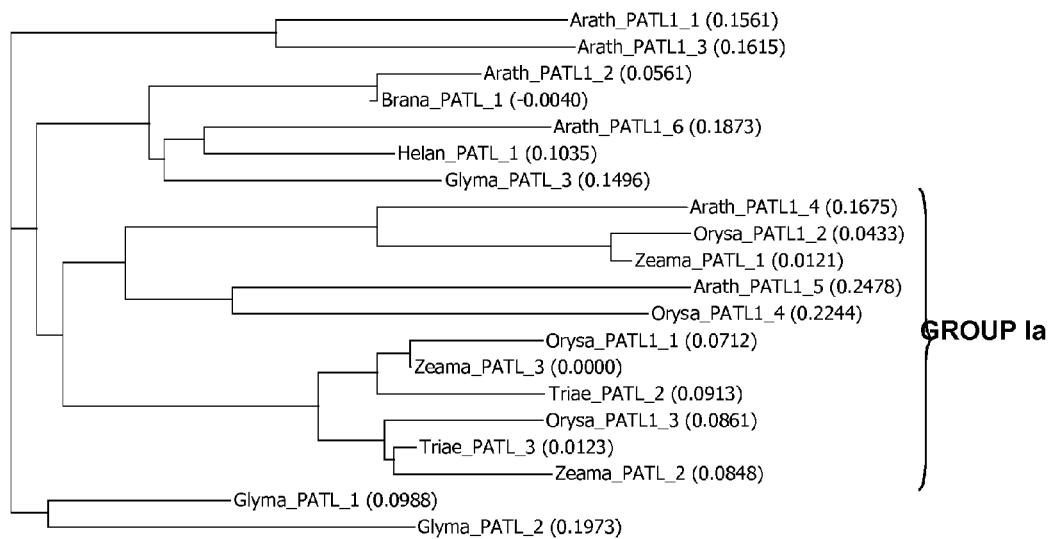
FIG. 3 shows a phylogenetic tree of a selection of PALT polypeptides of Table A1.

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the nucleic acid sequence used in the methods of the present invention were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length.

Table a Provides a List of Nucleic Acid Sequences Related to the Nucleic Acid Sequence Used in the Methods of the Present Invention.

The term "table A" used in this specification is to be taken to specify the content of table A1, and/or A2, and/or A3, and/or A4, and/or A5. The term "table A1" used in this specification is to be taken to specify the content of table A1. The term "table A2" used in this specification is to be taken to specify the content of table A2. The term "table A3" used in this specification is to be taken to specify the content of table A3. The term "table A4" used in this specification is to be taken to specify the content of table A4. The term "table A5" used in this specification is to be taken to specify the content of table A5. In one preferred embodiment, the term "table A" means table A1. In one preferred embodiment, the term "table A" means table A2. In one preferred embodiment, the term "table A" means table A3. In one preferred embodiment, the term "table A" means table A4. In one preferred embodiment, the term "table A" means table A5.

The term "table B" used in this specification is to be taken to specify the content of table B1, and/or B2, and/or B3, and/or B4, and/or B5. The term "table B1" used in this specification is to be taken to specify the content of table B1. The term "table B2" used in this specification is to be taken to specify the content of table B2. The term "table B3" used in this specification is to be taken to specify the content of table B3. The term "table B4" used in this specification is to be taken to specify the content of table B4. The term "table B5" used in this specification is to be taken to specify the content of table B5. In one preferred embodiment, the term "table B" means table B1. In one preferred embodiment, the term "table B" means table B2. In one preferred embodiment, the term "table B" means table B3. In one preferred embodiment, the term "table B" means table B4. In one preferred embodiment, the term "table B" means table B5.

The term "table C" used in this specification is to be taken to specify the content of table C1, and/or C2, and/or C3, and/or C4, and/or C5. The term "table C1" used in this specification is to be taken to specify the content of table C1. The term "table C2" used in this specification is to be taken to specify the content of table C2. The term "table C3" used in this specification is to be taken to specify the content of table C3. The term "table C4" used in this specification is to be taken to specify the content of table C4. The term "table C5" used in this specification is to be taken to specify the content of table C5. In one preferred embodiment, the term "table C" means table C1. In one preferred embodiment, the term "table C" means table C2. In one preferred embodiment, the term "table C" means table C3. In one preferred embodiment, the term "table C" means table C4. In one preferred embodiment, the term "table C" means table C5.

The term "table D" used in this specification is to be taken to specify the content of table D1, and/or D2, and/or D3, and/or D4, and/or D5. The term "table D1" used in this specification is to be taken to specify the content of table D1. The term "table D2" used in this specification is to be taken to specify the content of table D2. The term "table D3" used in this specification is to be taken to specify the content of table D3. The term "table D4" used in this specification is to be taken to specify the content of table D4. The term "table D5" used in this specification is to be taken to specify the content of table D5. In one preferred embodiment, the term "table D" means table D1. In one preferred embodiment, the term "table D" means table D2. In one preferred embodiment, the term "table D" means table D3. In one preferred embodiment, the term "table D" means table D4. In one preferred embodiment, the term "table D" means table D5.

TABLE A1

Examples of PATL nucleic acids and polypeptides:

| Name | Species of origin | Nucleic acid SEQ ID NO: | Polypeptide SEQ ID NO: |
|---|---|---|---|
| Orysa_PATL_1 | Oryza sativa | 1 | 2 |
| Orysa_PATL_2 | Oryza sativa | 3 | 4 |
| Orysa_PATL_3 | Oryza sativa | 5 | 6 |
| Orysa_PATL_4 | Oryza sativa | 7 | 8 |
| Brana_PATL_1 | Brasica napus | 9 | 10 |
| Helan_PATL_1 | Heliantus annus | 11 | 12 |
| Zeama_PATL_1 | Zea mays | 13 | 14 |
| Glyma_PATL_1 | Glycine max | 15 | 16 |
| Triaes_PATL_2 | Triticum aestivum | 17 | 18 |
| Triaes_PATL_3 | Triticum aestivum | 19 | 20 |
| Glyma_PATL_2 | Glycine max | 21 | 22 |
| Glyma_PATL_3 | Glycine max | 23 | 24 |
| Zeama_PATL_2 | Zea mays | 25 | 26 |
| Zeama_PATL_4 | Zea mays | 27 | 28 |
| Sacof_PATL_1 | Saccharum officinarum | 29 | 30 |
| Sacof_PATL_2 | Saccharum officinarum | 31 | 32 |
| Sacof_PATL_3 | Saccharum officinarum | 33 | 34 |
| Sacof_PATL_4 | Saccharum officinarum | 35 | 36 |
| Triae_PATL_1 | Triticum aestivum | 37 | 38 |
| Arath_PATL_1 | Arabdidopsis thaliana | 39 | 40 |
| Arath_PATL_2 | Arabdidopsis thaliana | 41 | 42 |
| Arath_PATL_3 | Arabdidopsis thaliana | 43 | 44 |
| Arath_PATL_4 | Arabdidopsis thaliana | 45 | 46 |
| Arath_PATL_5 | Arabdidopsis thaliana | 47 | 48 |
| Arath_PATL_6 | Arabdidopsis thaliana | 49 | 50 |
| Poptr_PATL_1 | Populus trichocarpa | 51 | 52 |
| Poptr_PATL_2 | Populus trichocarpa | 53 | 54 |
| Poptr_PATL_3 | Populus trichocarpa | 55 | 56 |
| Poptr_PATL_4 | Populus trichocarpa | 57 | 58 |
| Lyces_PATL_1 | Lycopersicum esculentum | 59 | 60 |
| Medtr_PATL_1 | Medicago truncatula | 61 | 62 |
| Betvu_PATL_1 | Beta vulgaris | 63 | 64 |
| Chlre_PATL_1 | Chlamydomonas reinhardtii | 65 | 66 |
| Dicdi_PATL_1 | Dictyostelium discoideum | 67 | 68 |

TABLE A2

Examples of PRP38 nucleic acids and polypeptides:

| Name | Species of origin | Nucleic acid SEQ ID NO: | Polypeptide SEQ ID NO: |
|---|---|---|---|
| Arath_PRP38_1 | Arabidopsis thaliana | SEQ ID NO: 76 | SEQ ID NO: 77 |
| Arath_PRP38_2 | Arabidopsis thaliana | SEQ ID NO: 78 | SEQ ID NO: 79 |
| Arath_PRP38_3 | Arabidopsis thaliana | SEQ ID NO: 80 | SEQ ID NO: 81 |
| Arath_PRP38_4 | Arabidopsis thaliana | SEQ ID NO: 82 | SEQ ID NO: 83 |
| Arath_PRP38_5 | Arabidopsis thaliana | SEQ ID NO: 84 | SEQ ID NO: 85 |

TABLE A2-continued

Examples of PRP38 nucleic acids and polypeptides:

| Name | Species of origin | Nucleic acid SEQ ID NO: | Polypeptide SEQ ID NO: |
|---|---|---|---|
| brasy_PRP38_1 | *Brachypodium sylvaticum* | SEQ ID NO: 86 | SEQ ID NO: 87 |
| brasy_PRP38_2 | *Brachypodium sylvaticum* | SEQ ID NO: 88 | SEQ ID NO: 89 |
| Chlre_PRP38_1 | *Chlamydomonas reinhardtii* | SEQ ID NO: 90 | SEQ ID NO: 91 |
| Horvu_PRP38_1 | *Hordeum vulgare* | SEQ ID NO: 92 | SEQ ID NO: 93 |
| Lyces_PRP38_1 | *Lycopersicum esculentum* | SEQ ID NO: 94 | SEQ ID NO: 95 |
| Medtr_PRP38_1 | *Medicago truncatula* | SEQ ID NO: 96 | SEQ ID NO: 97 |
| Orysa_PRP38_1 | *Oryza sativa* | SEQ ID NO: 98 | SEQ ID NO: 99 |
| Orysa_PRP38_2 | *Oryza sativa* | SEQ ID NO: 100 | SEQ ID NO: 101 |
| Ostta_PRP38_1 | *Ostreococcus tauri* | SEQ ID NO: 102 | SEQ ID NO: 103 |
| Ostta_PRP38_2 | *Ostreococcus tauri* | SEQ ID NO: 104 | SEQ ID NO: 105 |
| Poptr_PRP38_1 | *Populus trichocarpa* | SEQ ID NO: 106 | SEQ ID NO: 107 |
| Poptr_PRP38_2 | *Populus trichocarpa* | SEQ ID NO: 108 | SEQ ID NO: 109 |
| Sacof_PRP38_1 | *Saccharum officiarum* | SEQ ID NO: 110 | SEQ ID NO: 111 |
| Sacof_PRP38_3 | *Saccharum officiarum* | SEQ ID NO: 112 | SEQ ID NO: 113 |
| Schce_PRP38_1 | *Saccharomyces cerevisie* | SEQ ID NO: 114 | SEQ ID NO: 115 |
| Triae_PRP38_1 | *Triticum aestivum* | SEQ ID NO: 116 | SEQ ID NO: 117 |
| Vitvi_PRP38_1 | *Vitis vinifera* | SEQ ID NO: 118 | SEQ ID NO: 119 |

TABLE A3

Examples of GATA-like polypeptides:

| Plant Source | Nucleic acid SEQ ID NO: | Protein SEQ ID NO: |
|---|---|---|
| *Oryza sativa* | 128 | 129 |
| *Oryza sativa* | 137 | 138 |
| *Oryza sativa* | 139 | 140 |
| *Oryza sativa* | 141 | 142 |
| *Oryza sativa* | 143 | 144 |
| *Oryza sativa* | 145 | 146 |
| *Arabidopsis thaliana* | 147 | 148 |
| *Arabidopsis thaliana* | 149 | 150 |
| *Arabidopsis thaliana* | 151 | 152 |
| *Arabidopsis thaliana* | 153 | 154 |
| *Arabidopsis thaliana* | 155 | 156 |
| *Arabidopsis thaliana* | 157 | 158 |
| *Arabidopsis thaliana* | 159 | 160 |
| *Vitis vinifera* | 161 | 162 |
| *Vitis vinifera* | 163 | 164 |
| *Arabidopsis thaliana* | 165 | 166 |
| *Vitis vinifera* | 167 | 168 |
| *Vitis vinifera* | 169 | 170 |
| *Oryza sativa* | 171 | 172 |
| *Oryza sativa* | 173 | 174 |
| *Arabidopsis thaliana* | 175 | 176 |
| *Oryza sativa* | 177 | 178 |

TABLE A4

Examples of ADA2 nucleic acids and polypeptides:

| Name | Species of origin | Nucleic acid SEQ ID NO: | Polypeptide SEQ ID NO: |
|---|---|---|---|
| Arath_ADA2_1 | *Arabidopsis thaliana* | 181 | 182 |
| Arath_ADA2_2 | *Arabidopsis thaliana* | 183 | 184 |
| Dicdi_ADA2_1 | *Dictyostelium discoideum* | 185 | 186 |
| Lyces_ADA2_1 | *Lycopersicum esculentum* | 187 | 188 |
| Lyces_ADA2_2 | *Lycopersicum esculentum* | 189 | 190 |
| Ostlu_ADA2_1 | *Ostreococcus lucimarinus* | 191 | 192 |
| Orysa_ADA2_1 | *Oryza sativa* | 193 | 194 |
| Poptr_ADA2_1 | *Populus trichocarpa* | 195 | 196 |
| Poptr_ADA2_2 | *Populus trichocarpa* | 197 | 198 |
| Poptr_ADA2_3 | *Populus trichocarpa* | 199 | 200 |
| Vitvi_ADA2_1 | *Vitis vinifera* | 201 | 202 |
| Zeama_ADA_1 | *Zea mays* | 203 | 204 |
| Zeama_ADA_2 | *Zea mays* | 205 | 206 |

TABLE A5

Examples of WDR23-like polypeptide sequences, and encoding nucleic acid sequences:

| Name | Source organism | Public database accession number | Nucleic acid sequence SEQ ID NO: | Polypeptide sequence SEQ ID NO: | Status |
|---|---|---|---|---|---|
| Arath_WDR23 | *Arabidopsis thaliana* | AT4G03020 | 215 | 216 | Full length |
| Aqufo_WDR23 | *Aquilegia formosa* x *Aquilegia pubescens* | DR934238, DT758266 | 217 | 218 | Full length |
| Brana_WDR23 | *Brassica napus* | Proprietary | 219 | 220 | Full length |
| Glyma_WDR23 | *Glycine max* | EH262769.1, BE807607.1, BM178842.1 | 221 | 222 | Full length |

TABLE A5-continued

Examples of WDR23-like polypeptide sequences, and encoding nucleic acid sequences:

| Name | Source organism | Public database accession number | Nucleic acid sequence SEQ ID NO: | Polypeptide sequence SEQ ID NO: | Status |
|---|---|---|---|---|---|
| Goshi_WDR23 | Gossypium hirsutum | DT571300, DW224686.1| | 223 | 224 | Full length |
| Helan_WDR23 | Helianthus annuus | Proprietary | 225 | 226 | Full length |
| Horvu_WDR23 II | Hordeum vulgare | TA42103_4513 | 227 | 228 | Full length |
| Linus_WDR23 | Linum usitatissum | Proprietary | 229 | 230 | Full length |
| Liter_WDR23 (or LEC14B) | Lithospermum erythrorhizon | D83074.1 | 231 | 232 | Full length |
| Lyces_WDR23 | Lycopersicon esculentum | BT013732.1 | 233 | 234 | Full length |
| Medtr_WDR23 | Medicago truncatula | TC107985 | 235 | 236 | Full length |
| Orysa_WDR23 | Oryza sativa | NM_001062054 (Os05g0407200) | 237 | 238 | Full length |
| Pinra_WDR23 | Pinus radiata | AEB27202 | 239 | 240 | Full length |
| Poptr_WDR23 | Populus tremuloides | scaff_XIV.822 [1577] f [31-1497] | 241 | 242 | Full length |
| Pruar_WDR23 (LEC14B) | Prunus armeniaca | U82760.1 | 243 | 244 | Full length |
| Sacof_WDR23 II | Saccharum officinarum | CA119761, CA209562.1, CA198970.1 | 245 | 246 | Full length |
| Triae_WRD23 | Triticum aestivum | TA81375_4565 | 247 | 248 | Full length |
| Triae_WRD23 II | Triticum aestivum | EA148218 | 249 | 250 | Full length |
| Vitvi_WDR23 | Vitis vinifera | EV236978.1, CB002670, EV235943 | 251 | 252 | Full length |
| Zeama_WDR23 | Zea mays | DT943774.1, DV536181.1, EE042623.2 | 253 | 254 | Full length |
| Zeama_WDR23 II | Zea mays | CO527332.1, CF004625.1, EB408231.1, DV163655.1 | 255 | 256 | Full length |
| Citsi_WDR23 | Citrus sinensis | DN620350, CN186594.1 | 257 | 258 | Partial |
| Glyma_WRD23 II | Glycine max | BQ741328.1, BI471220.1, CX708493.1 | 259 | 260 | Partial |
| Horvu_WDR23 I | Hordeum vulgare | BQ753299 | 261 | 262 | Partial |
| Horvu_WDR23 III | Hordeum vulgare | BQ471803.1, BM370019.2 | 263 | 264 | Partial |
| Pinta_WDR23 | Pinus taeda | CV034652, CX652385 | 265 | 266 | Partial |
| Sacof_WDR23 | Saccharum officinarum | CA146950, CF570656 | 267 | 268 | Partial |
| Sorbi_WDR23 | Sorghum bicolor | CB928406.1, BE599991, CF770659.1 | 269 | 270 | Partial |

Concerning the WDR23-like proteins, in some instances, related sequences have been tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. In still other instances, the sequences are obtained after a private, proprietary sequencing and assembly effort has been made, for example for Brassica napus, Helianthus annus and Linum usitatissum.

Example 2

Alignment of PATL PRP38, GATA-like, ADA2, and WDR23-like Polypeptide Sequences

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values were: for the gap open penalty of 10, for the gap extension penalty of 0.1 and the selected weight matrix was Blosum 62 (if polypeptides are aligned). Sequence conservation among PATL polypeptides was higher at the C-terminus than at the N-terminus. A consensus sequence is given. Conserved amino acids are indicated. The PATL polypeptides are aligned in FIG. 2. Comparison of FIG. 1 and FIG. 2 revealed the presence of the conserved domains and key amino acid residues indicated in FIG. 1 in the PATL polypeptides of FIG. 2. A phylogenetic tree of PATL polypeptides (FIG. 3) was constructed using a neighbour-joining clustering algorithm as provided in the AlignX programme from the Vector NTI (Invitrogen).

Figure 8:
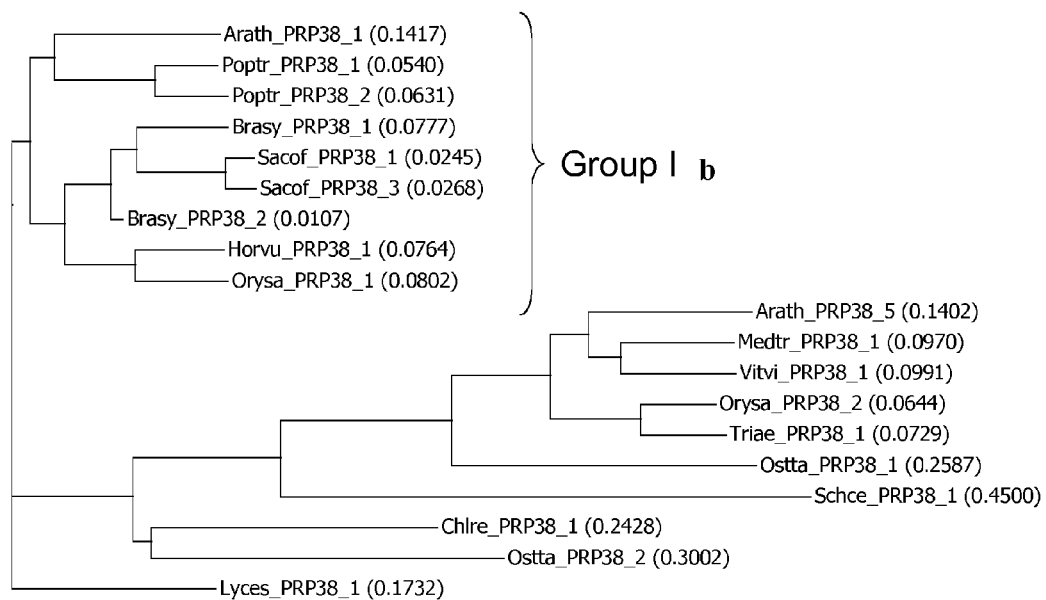
FIG. 8 shows a phylogenetic tree of the PRP38 polypeptides of Table A2.

Sequence conservation among PRP38 polypeptides was essentially in the N-terminal PRP38 domain of the polypeptides, the N-terminal domain usually being more variable in sequence length and composition, was enriched in acidic amino acids. The PRP38 polypeptides are aligned in FIG. 7. A phylogenetic tree of PRP38 polypeptides (FIG. 8) was constructed using a neighbour-joining clustering algorithm as provided in the AlignX programme from the Vector NTI (Invitrogen).

Sequence conservation among GATA-like polypeptides is essentially in the GATA domain of the polypeptides and in the C-terminus, the N-terminal domain usually being more variable in sequence length and composition. The GATA-like polypeptides are aligned in FIG. 12.

Figure 17:
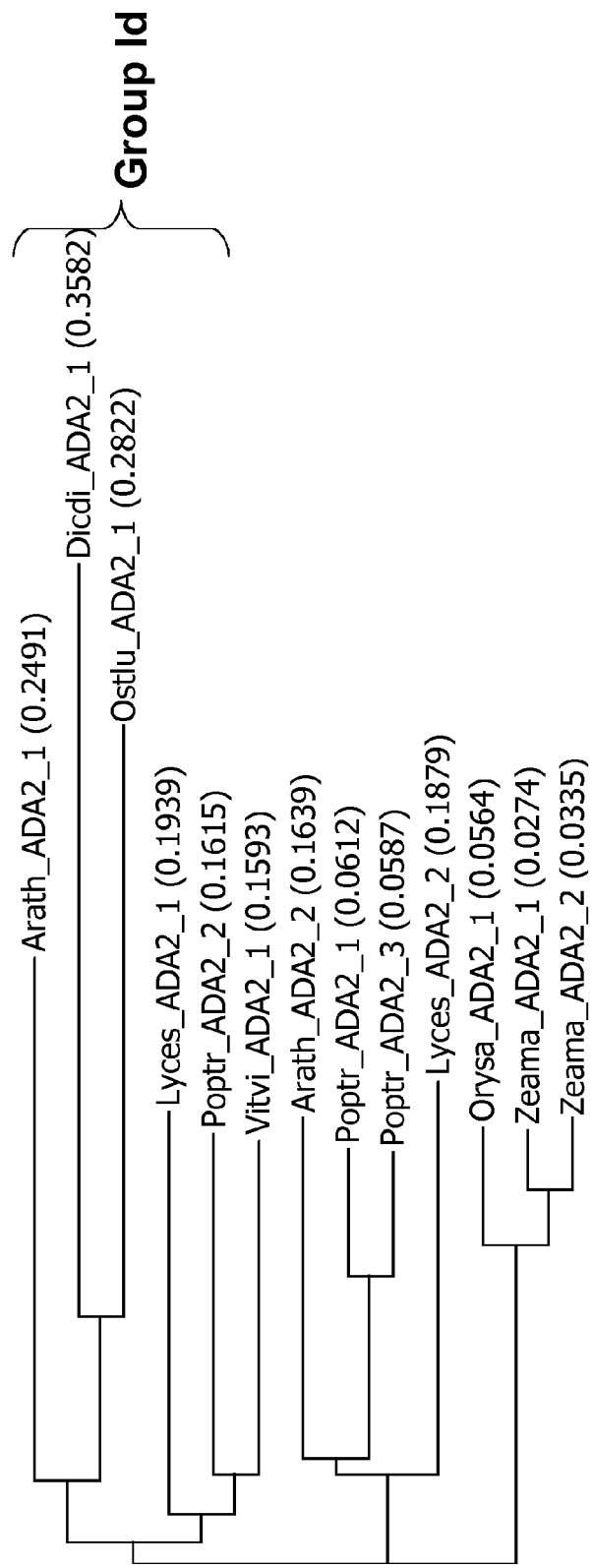
FIG. 17 shows a phylogenetic tree of the ADA2 polypeptides of Table A4.

Sequence conservation among ADA2 polypeptides was essentially along the conserved Zn finger ZZ type, SANT DNA binding and SWIRM domains of the polypeptides. A consensus sequence is given. The Zn finger ZZ type domain was enriched in cystein residues. The ADA2 polypeptides are aligned in FIG. 16. A phylogenetic tree of ADA2 polypeptides (FIG. 17) was constructed using a neighbour-joining clustering algorithm as provided in the AlignX programme from the Vector NTI (Invitrogen).

Mutliple sequence alignment of the full length WDR23-like polypeptide sequences in Table A5 was performed using the AlignX algorithm (from Vector NTI 10.3, Invitrogen Corporation). Results of the alignment are shown in FIGS. 23 and 24 of the present application.

FIG. 23 shows a sequence alignment representing the DxR motifs conserved in two consecutive blades of the WD40, in the WRD23 from *Homo sapiens* (NCBI accession AK057636), *Aspergillus niger* (NCBI accession CAK40817) and the plant WRD23-like polypeptides of Table A5.

Figure 24:
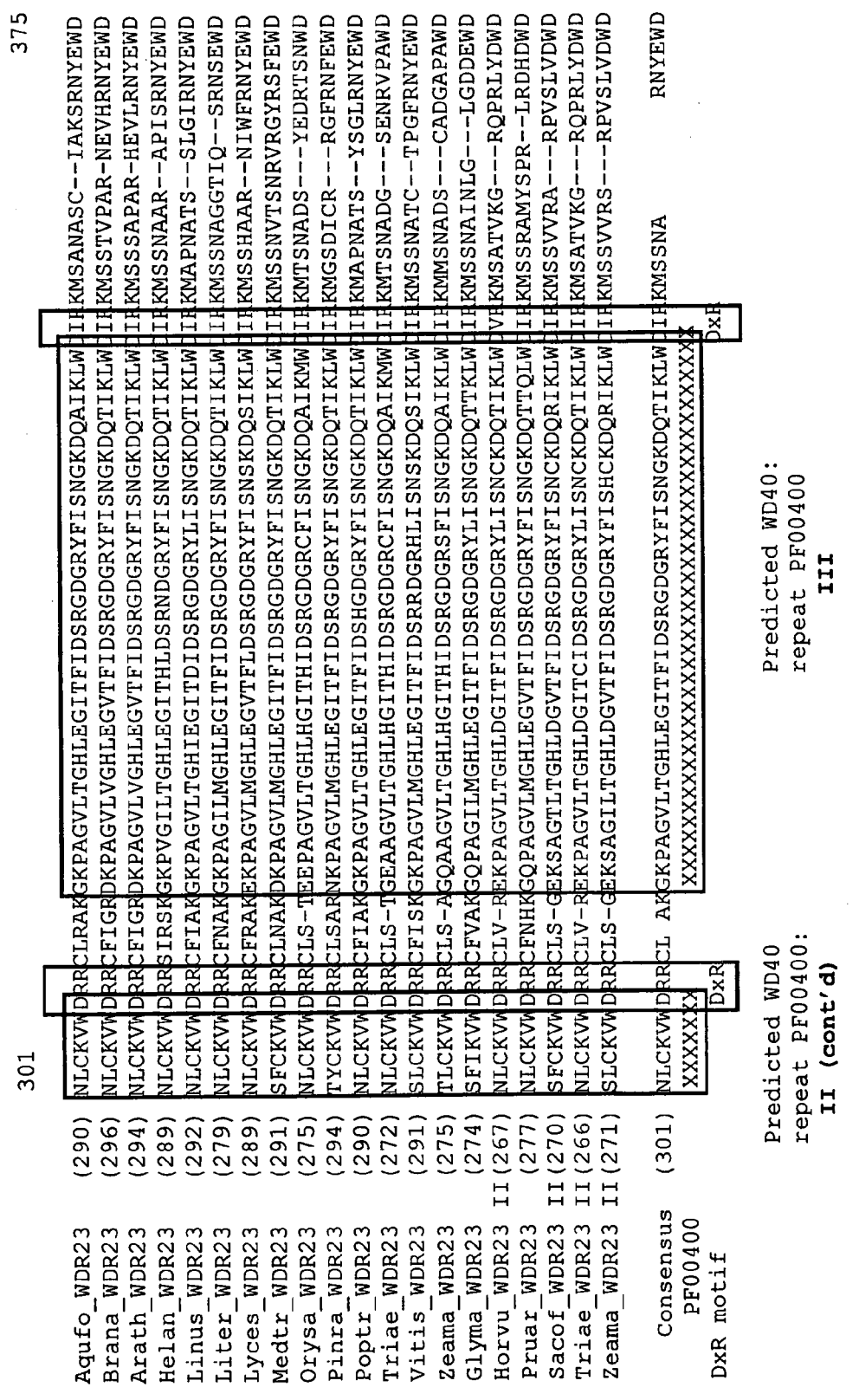

In FIG. 24, the beginning and the end of the Conserved Domain (CD), for example as represented by SEQ ID NO: 271, is shown using brackets. The WD40 repeats corresponding to PF00400 are marked by X's under the consensus sequence. The DxR motifs are also identified under the consensus sequence.

Example 3

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B1 for the global similarity and identity over the full length of the polypeptide sequences. Percentage identity is given above the diagonal in bold and percentage similarity is given below the diagonal (normal face).

The percentage identity between the PATL polypeptide sequences useful in performing the methods of the invention can be as low as 23.7% amino acid identity compared to Orysa_PATL_1 polypeptide (SEQ ID NO: 2).

TABLE B1

MatGAT results for global similarity and identity over the full length of the polypeptide sequences.
Table B1: Sequence similarity between PATL polypeptides

|  | 1 | 2 | 3 | 4 | 5 | 6 | 7 | 8 | 9 | 10 |
|---|---|---|---|---|---|---|---|---|---|---|
| 1. Zeama_PATL_2 |  | 42.9 | 69.0 | 46.5 | 38.4 | 66.9 | 44.9 | 31.5 | 24.2 | 28.0 |
| 2. Zeama_PATL_3 | 45.8 |  | 51.3 | 31.5 | 45.3 | 47.0 | 85.9 | 63.3 | 45.8 | 55.6 |
| 3. Zeama_PATL_4 | 76.1 | 52.0 |  | 48.8 | 42.4 | 75.9 | 47.2 | 34.2 | 25.8 | 30.1 |
| 4. Glyma_PATL_2 | 63.9 | 40.4 | 64.9 |  | 41.5 | 47.5 | 30.2 | 35.3 | 23.3 | 31.5 |
| 5. Glyma_PATL_3 | 48.9 | 56.1 | 53.2 | 53.0 |  | 40.9 | 43.6 | 48.5 | 34.5 | 52.1 |
| 6. Triaes_PATL_2 | 75.8 | 49.4 | 82.1 | 62.5 | 52.6 |  | 44.8 | 33.0 | 24.7 | 28.6 |
| 7. Triaes_PATL_3 | 47.7 | 91.0 | 50.1 | 38.9 | 54.7 | 48.2 |  | 62.6 | 47.0 | 54.4 |
| 8. Glyma_PATL_1 | 38.9 | 79.6 | 42.6 | 42.2 | 57.8 | 41.4 | 76.3 |  | 45.0 | 63.9 |
| 9. Zeama_PATL_1 | 33.9 | 65.4 | 35.9 | 33.8 | 47.2 | 36.1 | 65.7 | 67.8 |  | 43.0 |
| 10. Brana_PATL_1 | 36.6 | 74.1 | 39.4 | 39.4 | 61.8 | 38.3 | 71.5 | 78.2 | 64.2 |  |
| 11. Helan_PATL_1 | 29.5 | 61.8 | 32.9 | 31.8 | 51.9 | 31.5 | 59.6 | 63.9 | 52.8 | 68.1 |
| 12. Orysa_PATL_3 | 82.4 | 49.4 | 81.7 | 63.5 | 52.0 | 81.3 | 50.3 | 41.2 | 35.0 | 38.5 |
| 13. Orysa_PATL_4 | 53.5 | 41.2 | 56.7 | 55.3 | 52.2 | 56.4 | 40.8 | 41.6 | 40.0 | 38.1 |
| 14. Arath_PATL_1 | 57.7 | 37.0 | 62.7 | 60.1 | 50.4 | 59.3 | 36.0 | 38.7 | 32.3 | 37.9 |
| 15. Arath_PATL_2 | 52.4 | 47.8 | 57.3 | 57.3 | 70.8 | 56.2 | 46.3 | 49.8 | 41.0 | 61.4 |
| 16. Arath_PATL_3 | 57.0 | 30.0 | 52.9 | 59.0 | 43.5 | 53.1 | 30.3 | 32.1 | 29.0 | 31.9 |
| 17. Arath_PATL_4 | 42.9 | 49.9 | 46.4 | 44.7 | 61.6 | 45.7 | 49.9 | 51.6 | 65.5 | 50.1 |
| 18. Arath_PATL_5 | 55.8 | 39.1 | 58.1 | 59.1 | 52.8 | 57.6 | 40.6 | 40.7 | 36.3 | 40.0 |
| 19. Arath_PATL_6 | 56.3 | 35.6 | 55.2 | 60.5 | 51.6 | 53.4 | 34.9 | 36.8 | 30.2 | 39.1 |
| 20. Orysa_PATL1_1 | 80.6 | 48.6 | 83.4 | 63.5 | 49.8 | 84.8 | 47.5 | 40.3 | 33.9 | 37.5 |

|  | 11 | 12 | 13 | 14 | 15 | 16 | 17 | 18 | 19 | 20 |
|---|---|---|---|---|---|---|---|---|---|---|
| 1. Zeama_PATL_2 | 22.8 | 77.3 | 41.1 | 43.5 | 39.3 | 43.4 | 29.0 | 40.6 | 40.2 | 72.5 |
| 2. Zeama_PATL_3 | 47.9 | 46.2 | 30.3 | 27.1 | 36.0 | 22.5 | 34.4 | 27.9 | 27.0 | 46.8 |
| 3. Zeama_PATL_4 | 25.9 | 73.4 | 41.3 | 46.3 | 42.4 | 39.6 | 30.9 | 41.6 | 39.1 | 80.0 |
| 4. Glyma_PATL_2 | 25.5 | 47.2 | 37.9 | 46.1 | 44.4 | 44.4 | 31.8 | 40.4 | 42.4 | 48.4 |

TABLE B1-continued

MatGAT results for global similarity and identity over the full length of the polypeptide sequences.
Table B1: Sequence similarity between PATL polypeptides

| | | | | | | | | | | |
|---|---|---|---|---|---|---|---|---|---|---|
| 5. Glyma_PATL_3 | 43.6 | 41.2 | 36.2 | 35.2 | 57.6 | 30.2 | 41.9 | 34.8 | 41.3 | 39.0 |
| 6. Triaes_PATL_2 | 24.2 | 72.3 | 41.4 | 44.2 | 40.6 | 40.7 | 30.8 | 41.7 | 38.5 | 79.2 |
| 7. Triaes_PATL_3 | 46.8 | 47.8 | 31.2 | 26.5 | 35.4 | 22.5 | 33.8 | 29.0 | 26.0 | 44.3 |
| 8. Glyma_PATL_1 | 51.3 | 33.3 | 30.9 | 29.7 | 41.4 | 24.6 | 35.6 | 27.8 | 30.4 | 32.6 |
| 9. Zeama_PATL_1 | 38.7 | 25.0 | 27.9 | 19.6 | 27.4 | 17.1 | 53.9 | 23.5 | 20.8 | 23.7 |
| 10. Brana_PATL_1 | 57.0 | 28.9 | 27.3 | 27.4 | 59.4 | 22.4 | 36.1 | 27.0 | 34.3 | 28.0 |
| 11. Helan_PATL_1 | | 24.1 | 23.2 | 19.9 | 35.4 | 16.9 | 28.6 | 22.3 | 26.9 | 23.7 |
| 12. Orysa_PATL_3 | 31.5 | | 42.5 | 45.2 | 39.7 | 41.2 | 30.2 | 41.6 | 39.1 | 77.0 |
| 13. Orysa_PATL_4 | 33.7 | 56.6 | | 34.8 | 38.1 | 32.9 | 35.2 | 49.7 | 32.6 | 41.3 |
| 14. Arath_PATL_1 | 28.4 | 61.0 | 52.7 | | 38.5 | 58.3 | 27.6 | 39.1 | 35.9 | 44.2 |
| 15. Arath_PATL_2 | 42.9 | 54.4 | 54.2 | 55.3 | | 35.9 | 38.7 | 37.2 | 47.6 | 39.9 |
| 16. Arath_PATL_3 | 24.6 | 54.2 | 48.2 | 66.8 | 49.0 | | 24.8 | 36.1 | 35.7 | 41.3 |
| 17. Arath_PATL_4 | 40.6 | 45.0 | 50.3 | 43.5 | 56.3 | 37.9 | | 31.8 | 29.4 | 28.7 |
| 18. Arath_PATL_5 | 32.8 | 56.9 | 67.6 | 57.4 | 59.4 | 52.0 | 48.7 | | 33.1 | 40.4 |
| 19. Arath_PATL_6 | 31.9 | 53.4 | 46.6 | 50.9 | 58.2 | 55.3 | 40.4 | 50.6 | | 38.7 |
| 20. Orysa_PATL1_1 | 30.7 | 82.5 | 54.5 | 58.6 | 54.0 | 54.8 | 44.0 | 55.8 | 54.5 | |

Concerning the PRP38 polypeptides, results of the AlignX software analysis are shown in Table B2 for the global identity over the full length of selected polypeptide sequences from Table A2 compared to the Arath_PRP38_1 polypeptide (Table A2).

TABLE B2

Sequence similarity between PRP38 polypeptides

| PRP38 polypeptide | % sequence similarity to SEQ ID N0: 77 |
|---|---|
| Arath_PRP38_5 | 23.6 |
| brasy_PRP38_1 | 63.5 |
| brasy_PRP38_2 | 32.1 |
| Chlre_PRP38_1 | 40.6 |
| Horvu_PRP38_1 | 56.1 |
| Lyces_PRP38_1 | 60.7 |
| Medtr_PRP38_1 | 25.4 |
| Orysa_PRP38_1 | 60.9 |
| Orysa_PRP38_2 | 25.9 |

The percentage identity between the PRP38 polypeptide sequences of Table B2 and useful in performing the methods of the invention can be as low as 23.6% amino acid identity compared to SEQ ID NO: 77.

Concerning the GATA-like proteins, parameters used in the comparison were:

Scoring matrix: Blosum62

First Gap: 11

Extending gap: 1

Results of the software analysis are shown in Table B3 for the global similarity and identity over the full length of the polypeptide sequences. Percentage identity is given above the diagonal in bold and percentage similarity is given below the diagonal (normal face).

The percentage identity between the GATA-like polypeptide sequences useful in performing the methods of the invention can be as low as 14% amino acid identity compared to SEQ ID NO: 129.

TABLE B3

MatGAT results for global similarity and identity over the full length of the polypeptide sequences.

| | 1 | 2 | 3 | 4 | 5 | 6 | 7 | 8 | 9 | 10 | 11 |
|---|---|---|---|---|---|---|---|---|---|---|---|
| 1. GATAp | | 20.6 | 28.1 | 14.2 | 17.8 | 25.7 | 26.2 | 45.1 | 17.5 | 43.7 | 43.9 |
| 2. Q8LC79 | 33.7 | | 23.4 | 16.2 | 17.6 | 21.0 | 21.3 | 17.9 | 15.3 | 19.5 | 18.4 |
| 3. CAB79470 | 45.9 | 37.2 | | 16.8 | 17.3 | 52.8 | 29.5 | 28.3 | 16.5 | 28.1 | 27.3 |
| 4. Q8LC59 | 20.1 | 21.4 | 23.0 | | 39.6 | 14.6 | 28.4 | 14.4 | 38.4 | 15.0 | 14.5 |
| 5. A0JPW8 | 24.9 | 23.7 | 25.3 | 51.8 | | 17.8 | 30.5 | 16.3 | 42.5 | 17.9 | 16.4 |
| 6. Q1EBW4 | 42.0 | 34.2 | 65.3 | 18.8 | 23.9 | | 27.8 | 27.9 | 16.6 | 27.3 | 28.7 |
| 7. CAN63090 | 35.4 | 32.2 | 39.2 | 36.5 | 39.8 | 36.4 | | 23.0 | 30.7 | 22.2 | 23.8 |
| 8. A3BCY3 | 55.7 | 32.8 | 44.3 | 20.0 | 23.2 | 42.0 | 30.1 | | 16.5 | 85.1 | 97.9 |
| 9. A2XNM3 | 23.2 | 22.7 | 23.3 | 52.2 | 63.3 | 22.4 | 38.9 | 21.6 | | 18.2 | 16.7 |
| 10. Q5Z624 | 56.7 | 35.7 | 44.6 | 21.9 | 25.1 | 37.9 | 30.3 | 88.5 | 23.3 | | 83.3 |
| 11. A2YE96 | 56.7 | 32.5 | 42.5 | 21.0 | 23.4 | 42.7 | 30.6 | 98.4 | 21.8 | 87.9 | |
| 12. A2X2I3 | 98.3 | 34.9 | 48.0 | 21.9 | 26.5 | 42.0 | 36.0 | 56.8 | 23.9 | 58.5 | 57.3 |
| 13. Q5JNB8 | 23.5 | 23.1 | 25.6 | 52.1 | 57.0 | 23.4 | 38.4 | 22.9 | 74.6 | 22.5 | 23.7 |
| 14. A3A4M7 | 97.7 | 34.2 | 46.3 | 21.2 | 25.4 | 41.5 | 35.6 | 56.0 | 23.4 | 57.3 | 56.5 |
| 15. A5BCR3 | 20.7 | 21.0 | 25.3 | 66.4 | 69.8 | 22.4 | 38.4 | 21.1 | 66.2 | 22.5 | 21.0 |
| 16. CAO65359 | 32.6 | 32.2 | 32.4 | 38.7 | 45.3 | 33.9 | 58.8 | 32.0 | 42.0 | 31.4 | 31.7 |
| 17. AAL38250 | 42.0 | 34.4 | 65.1 | 19.6 | 23.4 | 99.7 | 36.7 | 41.2 | 22.1 | 38.9 | 41.2 |
| 18. AAM63829 | 20.1 | 21.4 | 23.3 | 100.0 | 51.8 | 19.3 | 37.9 | 20.0 | 52.2 | 21.9 | 21.0 |
| 19. ABK28715 | 20.1 | 21.4 | 23.6 | 99.2 | 51.8 | 19.6 | 37.9 | 20.0 | 52.9 | 21.9 | 21.0 |
| 20. AAB61058 | 25.6 | 21.8 | 27.5 | 21.8 | 15.8 | 30.0 | 20.2 | 24.4 | 14.9 | 26.4 | 26.2 |
| 21. CAO44870 | 21.8 | 22.0 | 23.3 | 60.0 | 59.7 | 20.6 | 37.4 | 20.0 | 56.6 | 21.0 | 20.4 |

TABLE B3-continued

MatGAT results for global similarity and identity over the full length of the polypeptide sequences.

|  | 12 | 13 | 14 | 15 | 16 | 17 | 18 | 19 | 20 | 21 |
|---|---|---|---|---|---|---|---|---|---|---|
| 1. GATAp | 98.3 | 18.6 | 97.2 | 15.9 | 26.5 | 25.7 | 14.2 | 14.1 | 14.2 | 15.6 |
| 2. Q8LC79 | 21.7 | 16.1 | 21.4 | 14.6 | 19.4 | 21.0 | 16.2 | 16.2 | 13.7 | 17.3 |
| 3. CAB79470 | 29.6 | 18.6 | 28.3 | 18.7 | 27.2 | 52.5 | 16.5 | 16.7 | 15.4 | 15.9 |
| 4. Q8LC59 | 15.0 | 36.1 | 14.4 | 47.4 | 28.2 | 15.2 | 99.2 | 99.2 | 21.6 | 42.5 |
| 5. A0JPW8 | 17.6 | 42.5 | 16.2 | 54.2 | 34.2 | 17.1 | 39.6 | 39.3 | 10.9 | 52.5 |
| 6. Q1EBW4 | 25.1 | 16.8 | 25.6 | 16.5 | 26.8 | 99.7 | 15.2 | 15.4 | 18.2 | 14.8 |
| 7. CAN63090 | 26.3 | 30.2 | 25.9 | 29.4 | 51.2 | 27.0 | 25.1 | 25.0 | 13.1 | 27.4 |
| 8. A3BCY3 | 44.9 | 17.9 | 43.4 | 14.7 | 23.7 | 27.8 | 14.4 | 14.4 | 13.5 | 16.0 |
| 9. A2XNM3 | 18.3 | 65.5 | 18.4 | 46.1 | 31.5 | 16.6 | 38.4 | 38.8 | 11.1 | 45.3 |
| 10. Q5Z624 | 44.2 | 19.8 | 43.4 | 15.3 | 21.7 | 27.7 | 15.0 | 14.9 | 14.8 | 16.4 |
| 11. A2YE96 | 44.9 | 18.8 | 43.4 | 14.8 | 23.9 | 29.0 | 14.5 | 14.5 | 14.0 | 16.1 |
| 12. A2X2I3 |  | 19.0 | 95.5 | 16.4 | 26.9 | 25.8 | 14.4 | 14.4 | 14.4 | 15.9 |
| 13. Q5JNB8 | 23.9 |  | 18.1 | 45.1 | 33.7 | 17.6 | 35.6 | 36.1 | 9.5 | 43.0 |
| 14. A3A4M7 | 96.0 | 22.9 |  | 15.8 | 26.2 | 25.3 | 13.6 | 13.5 | 13.9 | 15.5 |
| 15. A5BCR3 | 21.6 | 57.7 | 20.6 |  | 30.2 | 16.5 | 45.9 | 45.5 | 10.8 | 51.9 |
| 16. CAO65359 | 33.7 | 45.3 | 32.2 | 40.9 |  | 26.6 | 28.2 | 28.6 | 11.5 | 28.7 |
| 17. AAL38250 | 43.2 | 24.4 | 41.7 | 22.4 | 33.7 |  | 15.2 | 15.4 | 18.2 | 14.8 |
| 18. AAM63829 | 20.2 | 50.7 | 19.5 | 63.2 | 38.7 | 19.6 |  | 98.3 | 21.5 | 42.5 |
| 19. ABK28715 | 20.2 | 51.4 | 19.5 | 63.2 | 39.2 | 19.8 | 99.2 |  | 21.6 | 42.2 |
| 20. AAB61058 | 25.5 | 14.2 | 25.3 | 14.7 | 16.5 | 30.2 | 21.8 | 21.8 |  | 10.2 |
| 21. CAO44870 | 22.2 | 52.8 | 21.2 | 67.2 | 39.8 | 20.6 | 60.0 | 59.5 | 13.6 |  |

Concerning the ADA2 polypeptides, parameters used in the comparison were:
  Scoring matrix: Blosum62
  First Gap: 12
  Extending gap: 2

Results of the software analysis are shown in Table B4 for the global similarity and identity over the full length of the polypeptide sequences. Percentage identity is given above the diagonal in bold and percentage similarity is given below the diagonal (normal face).

The percentage identity between the ADA2 polypeptide sequences useful in performing the methods of the invention can be as low as 21.2% amino acid identity compared to Arath_ADA2_1 polypeptide (SEQ ID NO: 182).

Concerning the WDR23-like proteins, parameters used in the comparison were:
  Scoring matrix: Blosum62
  First Gap: 12
  Extending gap: 2

Results of the software analysis are shown in Table B5 for the global similarity and identity over the full length of the polypeptide sequences (excluding the partial polypeptide sequences).

TABLE B4

MatGAT results for global similarity and identity over the full length of the polypeptide sequences.
Table B4: Sequence similarity between ADA2 polypeptides

| Name | 1 | 2 | 3 | 4 | 5 | 6 | 7 | 8 | 9 | 10 | 11 | 12 | 13 |
|---|---|---|---|---|---|---|---|---|---|---|---|---|---|
| 1. Lyces_ADA2_2 |  | 55.3 | 21.2 | 52.7 | 49.2 | 57.3 | 57.1 | 61.6 | 56.7 | 57.3 | 58.6 | 57.9 | 33.5 |
| 2. Lyces_ADA2_1 | 73.2 |  | 19.7 | 57.0 | 46.1 | 54.5 | 53.8 | 54.0 | 65.0 | 65.4 | 52.4 | 54.6 | 33.1 |
| 3. Dicdi_ADA2_1 | 33.2 | 32.5 |  | 19.9 | 21.2 | 22.6 | 22.4 | 22.7 | 19.6 | 19.9 | 23.3 | 22.5 | 20.4 |
| 4. Arath_ADA2_2 | 69.1 | 71.6 | 31.3 |  | 45.2 | 50.8 | 51.1 | 50.4 | 59.4 | 61.0 | 51.2 | 51.3 | 35.2 |
| 5. Arath_ADA2_1 | 68.9 | 65.3 | 32.7 | 63.1 |  | 49.2 | 48.9 | 52.0 | 47.8 | 48.2 | 54.9 | 49.3 | 33.7 |
| 6. Zeama_ADA_2 | 72.0 | 69.6 | 35.4 | 66.2 | 65.8 |  | 94.7 | 58.4 | 58.0 | 58.1 | 54.0 | 87.7 | 34.3 |
| 7. Zeama_ADA_1 | 72.7 | 69.4 | 34.6 | 66.5 | 66.7 | 97.0 |  | 58.4 | 58.3 | 57.9 | 54.0 | 88.9 | 35.0 |
| 8. Vitvi_ADA2_1 | 78.4 | 68.4 | 34.9 | 66.3 | 67.2 | 74.7 | 74.3 |  | 59.1 | 59.6 | 62.3 | 59.2 | 33.1 |
| 9. Poptr_ADA2_1 | 73.9 | 77.5 | 32.5 | 72.0 | 68.6 | 72.9 | 73.3 | 74.3 |  | 87.9 | 55.1 | 58.0 | 33.3 |
| 10. Poptr_ADA2_3 | 74.5 | 78.0 | 32.6 | 73.5 | 66.5 | 73.6 | 73.8 | 75.0 | 93.8 |  | 54.5 | 56.9 | 32.8 |
| 11. Poptr_ADA2_2 | 76.3 | 69.8 | 34.2 | 69.3 | 71.0 | 70.3 | 70.1 | 75.0 | 71.3 | 71.9 |  | 55.2 | 33.2 |
| 12. Orysa_ADA2_1 | 72.5 | 68.6 | 34.5 | 66.8 | 66.5 | 93.7 | 94.4 | 75.4 | 73.4 | 73.4 | 70.4 |  | 35.8 |
| 13. Ostlu_ADA2_1 | 53.0 | 54.7 | 34.4 | 52.8 | 53.5 | 54.2 | 54.2 | 52.2 | 52.3 | 51.5 | 55.6 | 53.8 |  |

TABLE B5

MatGAT results for global similarity and identity over the full length of the polypeptide sequences of Table A5.

|  | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|
| 1. Aqufo_WDR23 |  | 74 | 75 | 67 | 86 | 67 | 59 | 72 | 66 | 70 | 70 | 61 | 71 | 77 | 68 | 54 | 61 | 58 | 78 | 60 | 54 |
| 2. Brana_WDR23 | 83 |  | 93 | 68 | 74 | 66 | 55 | 75 | 66 | 71 | 71 | 58 | 71 | 77 | 66 | 53 | 58 | 55 | 75 | 56 | 52 |
| 3. Arath_WDR23 | 84 | 96 |  | 68 | 75 | 67 | 56 | 75 | 66 | 71 | 70 | 58 | 72 | 78 | 66 | 54 | 58 | 56 | 76 | 56 | 54 |
| 4. Glyma_WDR23 | 78 | 79 | 80 |  | 68 | 60 | 56 | 67 | 66 | 67 | 66 | 58 | 66 | 69 | 70 | 53 | 57 | 56 | 69 | 57 | 53 |
| 5. Goshi_WDR23 | 91 | 85 | 85 | 79 |  | 67 | 58 | 73 | 65 | 70 | 71 | 59 | 73 | 76 | 66 | 52 | 59 | 56 | 76 | 59 | 52 |
| 6. Helan_WDR23 | 82 | 80 | 81 | 76 | 81 |  | 53 | 66 | 63 | 68 | 61 | 54 | 65 | 68 | 60 | 49 | 54 | 54 | 68 | 52 | 51 |
| 7. Horvu_WDR23 | 72 | 69 | 69 | 69 | 71 | 68 |  | 56 | 53 | 54 | 53 | 55 | 56 | 56 | 56 | 70 | 56 | 93 | 55 | 56 | 72 |
| 8. Linus_WDR23 | 82 | 85 | 86 | 78 | 85 | 79 | 69 |  | 67 | 68 | 69 | 59 | 71 | 78 | 64 | 50 | 59 | 56 | 74 | 57 | 51 |
| 9. Liter_WDR23 | 79 | 80 | 81 | 80 | 80 | 78 | 69 | 80 |  | 66 | 64 | 59 | 66 | 68 | 65 | 50 | 59 | 53 | 69 | 58 | 51 |
| 10. Lyces_WDR23 | 84 | 84 | 85 | 81 | 85 | 81 | 69 | 82 | 81 |  | 66 | 59 | 70 | 73 | 63 | 53 | 57 | 55 | 75 | 56 | 52 |
| 11. Medtr_WDR23 | 83 | 84 | 84 | 79 | 84 | 78 | 69 | 82 | 78 | 82 |  | 58 | 70 | 73 | 66 | 50 | 58 | 53 | 71 | 58 | 51 |
| 12. Orysa_WDR23 | 75 | 72 | 73 | 73 | 74 | 72 | 70 | 71 | 75 | 75 | 73 |  | 60 | 60 | 59 | 51 | 83 | 56 | 60 | 80 | 52 |
| 13. Pinra_WDR23 | 80 | 81 | 82 | 78 | 83 | 78 | 68 | 82 | 78 | 82 | 84 | 73 |  | 74 | 65 | 51 | 57 | 55 | 75 | 58 | 52 |
| 14. Poptr_WDR23 | 84 | 86 | 87 | 80 | 86 | 81 | 68 | 87 | 80 | 84 | 84 | 74 | 82 |  | 67 | 52 | 59 | 55 | 78 | 58 | 52 |
| 15. Pruar_WDR23 | 79 | 77 | 78 | 81 | 77 | 74 | 70 | 76 | 78 | 77 | 77 | 73 | 77 | 79 |  | 52 | 59 | 55 | 69 | 58 | 53 |
| 16. Sacof_WDR23 | 68 | 68 | 68 | 69 | 66 | 68 | 81 | 67 | 67 | 70 | 68 | 66 | 66 | 67 | 68 |  | 53 | 69 | 51 | 51 | 89 |
| 17. Triae_WDR23 | 74 | 70 | 71 | 71 | 72 | 72 | 69 | 72 | 75 | 72 | 72 | 92 | 71 | 72 | 75 | 67 |  | 57 | 59 | 76 | 53 |
| 18. Triae_WDR23 | 71 | 69 | 70 | 70 | 69 | 70 | 96 | 70 | 70 | 69 | 69 | 72 | 69 | 69 | 71 | 82 | 70 |  | 57 | 56 | 71 |
| 19. Vitis_WDR23 | 87 | 86 | 87 | 82 | 87 | 83 | 70 | 86 | 82 | 86 | 85 | 76 | 85 | 88 | 82 | 67 | 74 | 72 |  | 60 | 51 |
| 20. Zeama_WDR23 | 73 | 70 | 72 | 71 | 72 | 69 | 70 | 70 | 74 | 72 | 72 | 89 | 72 | 72 | 70 | 68 | 87 | 70 | 74 |  | 53 |
| 21. Zeama_WDR23 | 69 | 68 | 69 | 70 | 68 | 68 | 83 | 67 | 69 | 70 | 68 | 67 | 67 | 67 | 70 | 93 | 67 | 83 | 69 | 69 |  |

TABLE B5.1

MatGAT results for global similarity and identity over the Conserved Domain of the polypeptide sequences of Table A5.

|  | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|
| 1. CD_Aqufo_WDR23 |  | 82 | 81 | 77 | 85 | 76 | 73 | 79 | 77 | 81 | 80 | 74 | 81 | 85 | 78 | 68 | 73 | 72 | 86 | 73 | 68 |
| 2. CD_Arath_WDR23 | 91 |  | 96 | 77 | 81 | 74 | 70 | 80 | 77 | 80 | 79 | 70 | 80 | 84 | 76 | 69 | 71 | 70 | 81 | 69 | 69 |
| 3. CD_Brana_WDR23 | 89 | 98 |  | 76 | 81 | 72 | 69 | 81 | 76 | 79 | 79 | 70 | 79 | 83 | 75 | 66 | 70 | 69 | 81 | 69 | 66 |
| 4. CD_Glyma_WDR23 | 87 | 88 | 87 |  | 76 | 68 | 68 | 76 | 75 | 75 | 75 | 69 | 76 | 78 | 76 | 64 | 68 | 68 | 77 | 70 | 64 |
| 5. CD_Goshi_WDR23 | 90 | 90 | 90 | 87 |  | 74 | 70 | 81 | 75 | 79 | 81 | 71 | 83 | 83 | 76 | 65 | 71 | 70 | 82 | 72 | 65 |
| 6. CD_Helan_WDR23 | 88 | 87 | 85 | 82 | 87 |  | 66 | 74 | 73 | 75 | 70 | 66 | 73 | 76 | 69 | 63 | 66 | 66 | 75 | 65 | 64 |
| 7. CD_Horvu_WDR23\II | 84 | 83 | 82 | 81 | 82 | 80 |  | 69 | 65 | 68 | 66 | 68 | 71 | 70 | 68 | 79 | 69 | 97 | 69 | 69 | 80 |
| 8. CD_Linus_WDR23 | 88 | 91 | 90 | 88 | 90 | 85 | 81 |  | 76 | 77 | 79 | 71 | 79 | 86 | 74 | 63 | 72 | 69 | 81 | 70 | 65 |
| 9. CD_Liter_WDR23 | 87 | 89 | 88 | 86 | 88 | 85 | 80 | 88 |  | 75 | 75 | 70 | 76 | 79 | 73 | 62 | 69 | 65 | 77 | 69 | 63 |
| 10. CD_Lyces_WDR23 | 90 | 90 | 89 | 88 | 90 | 88 | 82 | 87 | 88 |  | 76 | 71 | 79 | 81 | 74 | 66 | 70 | 69 | 82 | 70 | 66 |
| 11. CD_Medtr_WDR23 | 90 | 91 | 90 | 87 | 91 | 86 | 80 | 89 | 88 | 90 |  | 70 | 80 | 83 | 77 | 65 | 70 | 66 | 80 | 69 | 65 |
| 12. CD_Orysa_WDR23 | 86 | 85 | 84 | 84 | 85 | 82 | 81 | 82 | 85 | 86 | 85 |  | 72 | 72 | 70 | 64 | 89 | 68 | 72 | 87 | 66 |
| 13. CD_Pinra_WDR23 | 88 | 88 | 87 | 87 | 90 | 85 | 82 | 87 | 87 | 89 | 92 | 84 |  | 83 | 76 | 66 | 71 | 70 | 82 | 71 | 66 |
| 14. CD_Poptr_WDR23 | 91 | 92 | 91 | 87 | 90 | 86 | 81 | 93 | 88 | 90 | 92 | 85 | 89 |  | 77 | 66 | 73 | 70 | 85 | 71 | 67 |
| 15. CD_Pruar_WDR23 | 87 | 86 | 85 | 87 | 85 | 83 | 81 | 85 | 84 | 87 | 87 | 82 | 85 | 86 |  | 64 | 70 | 68 | 77 | 70 | 66 |
| 16. CD_Sacof_WDR23\II | 80 | 80 | 78 | 79 | 77 | 79 | 88 | 78 | 77 | 81 | 78 | 79 | 79 | 79 | 78 |  | 66 | 78 | 64 | 64 | 94 |
| 17. CD_Triae_WDR23 | 87 | 84 | 83 | 83 | 85 | 83 | 81 | 85 | 85 | 85 | 85 | 96 | 84 | 84 | 81 | 79 |  | 70 | 71 | 85 | 66 |
| 18. CD_Triae_WDR23\II | 84 | 83 | 82 | 81 | 82 | 81 | 99 | 82 | 80 | 82 | 81 | 82 | 82 | 81 | 81 | 88 | 81 |  | 70 | 69 | 80 |
| 19. CD_Vitvi_WDR23 | 93 | 91 | 90 | 89 | 91 | 88 | 82 | 91 | 90 | 92 | 92 | 86 | 91 | 92 | 88 | 79 | 87 | 83 |  | 73 | 65 |
| 20. CD_Zeama_WDR23 | 85 | 83 | 82 | 82 | 84 | 81 | 81 | 81 | 83 | 84 | 84 | 93 | 84 | 84 | 80 | 80 | 93 | 81 | 86 |  | 66 |
| 21. CD_Zeama_WDR23_II | 82 | 82 | 81 | 81 | 79 | 80 | 89 | 80 | 80 | 83 | 79 | 80 | 80 | 81 | 80 | 97 | 79 | 89 | 81 | 81 |  |

The same analysis was done between the Conserved Domain (CD) as represented by SEQ ID NO: 271 (and comprised in SEQ ID NO: 216), and the Conserved Domain of the full length polypeptides of Table A5 (as highlighted in FIG. 24), and results are shown in Table B5.1.

The percentage identity between the full length polypeptide sequences useful in performing the methods of the invention can be as low as 54% amino acid identity compared to SEQ ID NO: 216.

The percentage identity between the Conserved Domain (CD) as represented by SEQ ID NO: 271 (and comprised in SEQ ID NO: 216), and the Conserved Domain of the polypeptides of Table A5 (as highlighted in FIG. 24) increases to 69% amino acid identity, as shown in Table B5.1.

Example 4
Identification of Domains Comprised in Polypeptide Sequences Useful in Performing the Methods of the Invention Conserved domain proteins were identified by searching the InterPro database. The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, Panther, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 2 are presented in Table C5.

TABLE C5

InterPro scan results (major accession numbers) of the polypeptide sequence as represented by SEQ ID NO: 2.

| Query sequence | Interpro accession number | Other database accession | Description domain | Short name domain | Evalue | Amino acid coordinate: Start | Amino acid coordinate: End | Method |
|---|---|---|---|---|---|---|---|---|
| Orysa_PATL1_1 | IPR000348 | PF01105 | emp24/gp25L/p24 | EMP24_GP25L | 1.7E−17 | 525 | 606 | HMMPfam |
| Orysa_PATL1_1 | IPR001251 | PF00650 | Cellular retinaldehyde-binding/triple function, C-terminal | CRAL_TRIO | 7.5E−14 | 336 | 507 | HMMPfam |
| Orysa_PATL1_1 | IPR001251 | SM00516 | Cellular retinaldehyde-binding/triple function, C-terminal | SEC14 | 3.1E−36 | 328 | 496 | HMMSmart |
| Orysa_PATL1_1 | IPR001251 | PS50191 | Cellular retinaldehyde-binding/triple function, C-terminal | CRAL_TRIO | 17.735 | 324 | 499 | ProfileScan |
| Orysa_PATL1_1 | IPR001251 | SSF52087 | Cellular retinaldehyde-binding/triple function, C-terminal | CRAL_TRIO_C | 1.06E−12 | 334 | 500 | superfamily |
| Orysa_PATL1_1 | IPR008273 | PF03765 | Cellular retinaldehyde-binding/triple function, N-terminal | CRAL_TRIO_N | 0.00024 | 206 | 321 | HMMPfam |
| Orysa_PATL1_1 | IPR009038 | PS50866 | GOLD | GOLD | 10.429 | 505 | 606 | ProfileScan |
| Orysa_PATL1_1 | IPR011074 | SSF46938 | Phosphatidylinositol transfer protein-like, N-terminal | Sec14p_like_N | 2.57E−12 | 271 | 325 | superfamily |
| Orysa_PATL1_2 | IPR000348 | PF01105 | emp24/gp25L/p24 | EMP24_GP25L | 4.7 | 348 | 430 | HMMPfam |
| Orysa_PATL1_2 | IPR001071 | PR00180 | Cellular retinaldehyde binding/alpha-tocopherol transport | CRETINALDHBP | 1.6E−05 | 111 | 133 | FPrintScan |
| Orysa_PATL1_2 | IPR001071 | PR00180 | Cellular retinaldehyde binding/alpha-tocopherol transport | CRETINALDHBP | 1.6E−05 | 273 | 292 | FPrintScan |
| Orysa_PATL1_2 | IPR001251 | PF00650 | Cellular retinaldehyde-binding/triple function, C-terminal | CRAL_TRIO | 1.3E−19 | 244 | 317 | HMMPfam |
| Orysa_PATL1_2 | IPR001251 | SM00516 | Cellular retinaldehyde-binding/triple function, C-terminal | SEC14 | 3.00E−39 | 154 | 318 | HMMSmart |
| Orysa_PATL1_2 | IPR001251 | PS50191 | Cellular retinaldehyde-binding/triple function, C-terminal | CRAL_TRIO | 17.846 | 147 | 321 | ProfileScan |
| Orysa_PATL1_2 | IPR001251 | SSF52087 | Cellular retinaldehyde-binding/triple function, C-terminal | CRAL_TRIO_C | 1.2E−33 | 149 | 319 | superfamily |
| Orysa_PATL1_2 | IPR008273 | PF03765 | Cellular retinaldehyde-binding/triple function, N-terminal | CRAL_TRIO_N | 0.0037 | 52 | 145 | HMMPfam |
| Orysa_PATL1_2 | IPR009038 | PS50866 | GOLD | GOLD | 9.253 | 297 | 432 | ProfileScan |
| Orysa_PATL1_2 | IPR011074 | SSF46938 | Phosphatidylinositol transfer protein-like, N-terminal | Sec14p_like_N | 2.6E−12 | 32 | 148 | superfamily |
| Orysa_PATL1_3 | IPR000348 | PF01105 | emp24/gp25L/p24 | EMP24_GP25L | 2.3E−16 | 496 | 578 | HMMPfam |
| Orysa_PATL1_3 | IPR001071 | PR00180 | Cellular retinaldehyde binding/alpha-tocopherol transport | CRETINALDHBP | 6.9E−06 | 258 | 280 | FPrintScan |
| Orysa_PATL1_3 | IPR001071 | PR00180 | Cellular retinaldehyde binding/alpha-tocopherol transport | CRETINALDHBP | 6.9E−06 | 389 | 410 | FPrintScan |
| Orysa_PATL1_3 | IPR001071 | PR00180 | Cellular retinaldehyde binding/alpha-tocopherol transport | CRETINALDHBP | 6.9E−06 | 422 | 441 | FPrintScan |
| Orysa_PATL1_3 | IPR001251 | PF00650 | Cellular retinaldehyde-binding/triple function, C-terminal | CRAL_TRIO | 1.5E−14 | 307 | 471 | HMMPfam |
| Orysa_PATL1_3 | IPR001251 | SM00516 | Cellular retinaldehyde-binding/triple function, C-terminal | SEC14 | 2.8E−36 | 299 | 467 | HMMSmart |
| Orysa_PATL1_3 | IPR001251 | PS50191 | Cellular retinaldehyde-binding/triple function, C-terminal | CRAL_TRIO | 17.567 | 295 | 470 | ProfileScan |
| Orysa_PATL1_3 | IPR001251 | SSF52087 | Cellular retinaldehyde-binding/triple function, C-terminal | CRAL_TRIO_C | 1.00E−29 | 296 | 469 | superfamily |
| Orysa_PATL1_3 | IPR008273 | PF03765 | Cellular retinaldehyde-binding/triple function, N-terminal | CRAL_TRIO_N | 0.0011 | 189 | 292 | HMMPfam |
| Orysa_PATL1_3 | IPR009038 | PS50866 | GOLD | GOLD | 11.168 | 472 | 578 | ProfileScan |

TABLE C5-continued

InterPro scan results (major accession numbers) of the polypeptide sequence as represented by SEQ ID NO: 2.

| Query sequence | Interpro accession number | Other database accession | Description domain | Short name domain | Evalue | Amino acid coordinate: Start | Amino acid coordinate: End | Method |
|---|---|---|---|---|---|---|---|---|
| Orysa_PATL1_3 | IPR011074 | SSF46938 | Phosphatidylinositol transfer protein-like, N-terminal | Sec14p_like_N | 4.3E−10 | 241 | 295 | superfamily |
| Orysa_PATL1_4 | IPR000348 | PF01105 | emp24/gp25L/p24 | EMP24_GP25L | 2.4E−05 | 429 | 509 | HMMPfam |
| Orysa_PATL1_4 | IPR001071 | PR00180 | Cellular retinaldehyde binding/alpha-tocopherol transport | CRETINALDHBP | 1.1E−05 | 184 | 206 | FPrintScan |
| Orysa_PATL1_4 | IPR001071 | PR00180 | Cellular retinaldehyde binding/alpha-tocopherol transport | CRETINALDHBP | 1.1E−05 | 387 | 396 | FPrintScan |
| Orysa_PATL1_4 | IPR001251 | PF00650 | Cellular retinaldehyde-binding/triple function, C-terminal | CRAL_TRIO | 8.9E−17 | 323 | 423 | HMMPfam |
| Orysa_PATL1_4 | IPR001251 | SM00516 | Cellular retinaldehyde-binding/triple function, C-terminal | SEC14 | 5.5E−34 | 230 | 398 | HMMSmart |
| Orysa_PATL1_4 | IPR001251 | PS50191 | Cellular retinaldehyde-binding/triple function, C-terminal | CRAL_TRIO | 17.609 | 226 | 401 | ProfileScan |
| Orysa_PATL1_4 | IPR001251 | SSF52087 | Cellular retinaldehyde-binding/triple function, C-terminal | CRAL_TRIO_C | 5.5E−31 | 225 | 400 | superfamily |
| Orysa_PATL1_4 | IPR008273 | PF03765 | Cellular retinaldehyde-binding/triple function, N-terminal | CRAL_TRIO_N | 0.00015 | 145 | 215 | HMMPfam |
| Orysa_PATL1_4 | IPR009038 | PS50866 | GOLD | GOLD | 9.345 | 402 | 509 | ProfileScan |
| Orysa_PATL1_4 | IPR011074 | SSF46938 | Phosphatidylinositol transfer protein-like, N-terminal | Sec14p_like_N | 9.1E−10 | 125 | 223 | superfamily |

Abreviations of databases in the database accessions:
PF: Pfam;
PS: Prosite;
SM: Smart;
SSF: Superfamily.

The results of the Pfam scan of the polypeptide sequence as represented by SEQ ID NO: 77 are presented in Table C2.

TABLE C2

Pfam scan results (major accession numbers) of the polypeptide sequence of Table A2. The amino acid coordinates delimiting the domain (Domain Name) in the scanned polypeptide (Query Polypeptide) are given. The e-value of the alignment of the query Polypeptide to the hit in the Pfam entry is given.

| Query Polypeptide | Domain Name | Amino acid coordinate: Start | Amino acid coordinate: End | Evalue |
|---|---|---|---|---|
| Arath_PRP38_1 | PRP38 | 1 | 170 | 2.4e−31 |
| Arath_PRP38_1 | DUF1777 | 255 | 389 | 0.026 |
| Arath_PRP38_4 | DUF1777 | 87 | 221 | 0.026 |
| Arath_PRP38_5 | PRP38 | 1 | 177 | 9.3e−65 |
| Arath_PRP38_5 | DUF1777 | 208 | 355 | 0.15 |
| Brasy_PRP38_1 | PRP38 | 1 | 169 | 1.5e−24 |
| Brasy_PRP38_1 | DUF1777 | 251 | 392 | 0.14 |
| Brasy_PRP38_2 | PRP38 | 1 | 162 | 1E−15 |
| Chlre_PRP38_1 | PRP38 | 1 | 169 | 1.9e−22 |
| Chlre_PRP38_1 | DUF1777 | 289 | 354 | 0.77 |
| Horvu_PRP38_1 | PRP38 | 1 | 169 | 2.1e−29 |
| Lyces_PRP38_1 | PRP38 | 1 | 170 | 3.5e−26 |
| Lyces_PRP38_1 | DUF1777 | 266 | 428 | 0.024 |
| Medtr_PRP38_1 | PRP38 | 1 | 177 | 5E−71 |
| Orysa_PRP38_1 | PRP38 | 1 | 169 | 2.9e−29 |
| Orysa_PRP38_1 | DUF1777 | 270 | 434 | 0.1 |
| Orysa_PRP38_2 | PRP38 | 1 | 177 | 5.5e−75 |
| Orysa_PRP38_2 | DUF1777 | 235 | 392 | 0.071 |
| Ostta_PRP38_1 | PRP38 | 1 | 146 | 6.5e−41 |
| Ostta_PRP38_2 | PRP38 | 16 | 191 | 7.1e−10 |
| Poptr_PRP38_1 | PRP38 | 1 | 169 | 5.8e−29 |
| Poptr_PRP38_1 | DUF1777 | 263 | 414 | 0.0074 |
| Poptr_PRP38_2 | PRP38 | 1 | 169 | 3.7e−26 |
| Poptr_PRP38_2 | DUF1777 | 258 | 414 | 0.23 |
| Sacof_PRP38_1 | PRP38 | 1 | 169 | 8.6e−27 |
| Sacof_PRP38_3 | PRP38 | 1 | 169 | 3.3e−27 |
| Sacof_PRP38_3 | DUF1777 | 263 | 375 | 0.067 |
| Schce_PRP38_1 | PRP38 | 6 | 221 | |
| Triae_PRP38_1 | PRP38 | 1 | 177 | 4.6e−71 |
| Triae_PRP38_1 | DUF1777 | 220 | 371 | 0.17 |
| Vitvi_PRP38_1 | PRP38 | 1 | 177 | 4.6e−71 |
| Vitvi_PRP38_1 | DUF1777 | 220 | 371 | 0.17 |

The results of the InterPro scan of the polypeptide sequence as represented by SEQ ID NO: 129 are presented in Table C3.

TABLE C3

InterPro scan results (major accession numbers) of the polypeptide sequence as represented by SEQ ID NO: 129.

| Database | Accession number | Accession name | Amino acid coordinates on SEQ ID NO 129 |
|---|---|---|---|
| InterPro HMMPfam | IPR000679 PF00320 | Zn-finger, GATA type GATA | T[178-213] 1.9E-14 |
| HMMSmart | SM00401 | ZnF_GATA | T[172-223] 1.1E-16 |
| ProfileScan | PS50114 | GATA_ZN_FINGER_2 | T[176-208] 12.268 |

The results of the InterPro scan of the polypeptide sequence as represented by SEQ ID NO: 182 are presented in Table C4.

TABLE C4

InterPro scan results (major accession numbers) of the polypeptide sequence as represented by SEQ ID NO: 182.
Table C4: Pfam scan results (major accession numbers) of the polypeptide sequence of Table A4. The amino acid coordinates delimiting the domain (Domain Name) in the scanned polypeptide (Query Polypeptide) are given. The e-value of the alignment of the query Polypeptide to the hit in the Pfam entry is given.

| INTERPRO Scan | Zn finger ZZ type (PFAM)/amino acid coordinates (start-end) | SANT DNA binding (SMART)/amino acid coordinates (start-end) | Ca binding EF hand (PROSITE)/amino acid coordinates (start-end) | SWIRM (PFAM)/ amino acid coordinates (start-end) |
|---|---|---|---|---|
| At ADA2a | 47-92 | 107-156 | 287-299 | 461-547 |
| Ol ADA2_1 | 27-72 | 87-136 | | 371-457 |
| Ot ADA2_1 | 26-71 | 86-135 | | |
| Pt ADA2_1 | 55-100 | 115-164 | 271-283 | 454-540 |
| Vv ADA2_1 | 45-90 | 105-154 | 286-298 | 474-560 |
| At ADA2b | 41-86 | 101-150 | 241-253 | 397-483 |
| PtADA2_2 | 44-89 | 104-153 | 304-316 | 474-560 |
| PtADA2_3 | 44-89 | 104-153 | 303-315 | 473-559 |
| Vv ADA2_2 | 1-40 | 55-104 | 241-253 | 397-483 |
| Sl ADA2_2 | 43-88 | 103-152 | | 457-543 |
| Hv ADA2_1 | 45-90 | 105-154 | | |
| Os ADA2_1 | 47-92 | 107-156 | 290-302 | 476-562 |
| Os ADA2_3 | 47-92 | 107-156 | 390-402 | 576-662 |
| Zm ADA2_1 | 47-92 | 107-156 | 293-305 | 474-559 |
| Zm ADA2_2 | 47-92 | 107-156 | 293-305 | 474-559 |
| Sl ADA2_1 | 44-89 | 104-153 | 288-300 | 474-560 |

The results of the InterPro scan of the polypeptide sequence as represented by SEQ ID NO: 216 are presented in Table C5.

TABLE C5

InterPro scan results of the polypeptide sequence as represented by SEQ ID NO: 216

| InterPro accession number and name | Integrated database name | Integrated database accession number | Integrated database accession name |
|---|---|---|---|
| IPR0001680 WD40 repeat | PFAM | PF00400 | WD40 |
| IPR0001680 WD40 repeat | Smart | SM00320 | WD40 |
| IPR0001680 WD40 repeat | ProfileScan | PS50082 | WD_repeats_2 |
| IPR0001680 WD40 repeat | ProfileScan | PS50294 | WD_REPEATS_REGION |
| IPR0001680 WD40 repeat | FPrintScan | PR00320 | GPROTEINBRPT |
| IPR011046 WD40 repeat-like | SuperFamily | SSF50978 | WD40_like |
| IPR15943 WD40/YVTN repeat-like | Gene3D | G3DSA: 2.130.10.10 | WD40/YVTN repeat-like |

Example 5

Cloning of the Nucleic Acid Sequence Used in the Methods of the Invention

The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix. Concerning PATL, the primers used were SEQ ID NO: 73: 5'-ggggacaagtttgtacaaaaaagcaggcttaaacaatggcggaggagccac-3' and SEQ ID NO: 74; 5'-ggggaccactttgtacaa-gaaagctgggtgtggtgaatctggtgatcagg-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pOrysa_PATL_

1. Plasmid pDONR201 was purchased from Invitrogen, as part of the Gateway® technology.

The entry clone comprising SEQ ID NO: 1 was then used in an LR reaction with two destination vector used for *Oryza sativa* transformation. A first vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 75) for constitutive expression was located upstream of this Gateway cassette.

Figure 4:
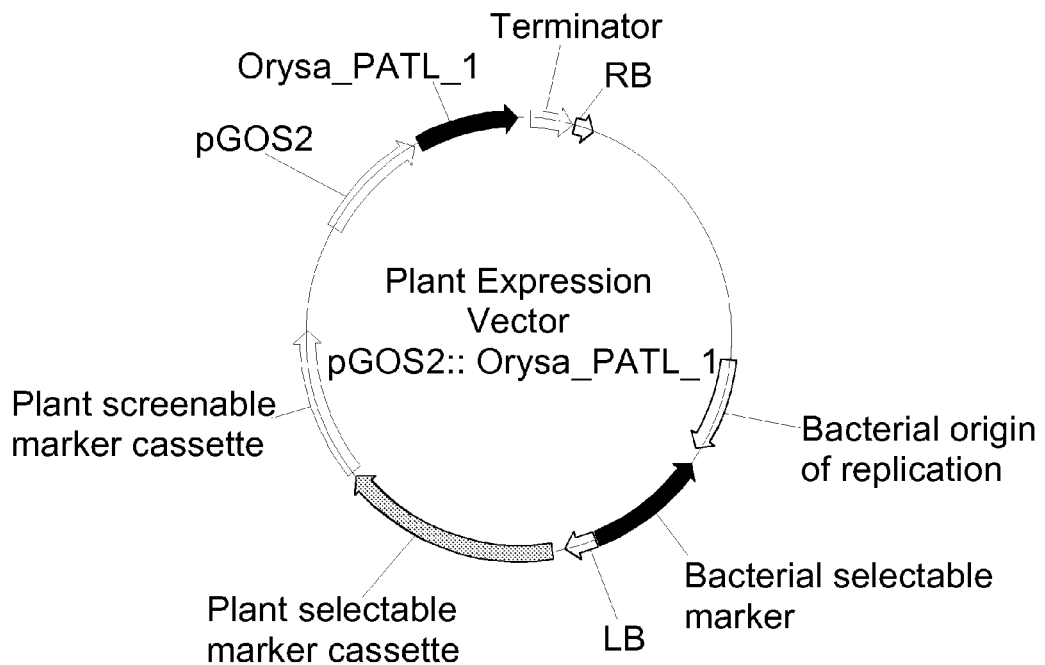
FIG. 4 represents the binary vector for increased expression in Oryza sativa of a PALT encoding nucleic acid under the control of a rice GOS2 promoter.

After the LR recombination step, the resulting expression vectors pGOS2::*Orysa*_PATL_1 (FIG. 4) was transformed into *Agrobacterium* strain LBA4044 according to methods well known in the art.

Concerning the PRP38, the primers used were SEQ ID NO: 125: 5' ggggacaagtttgtacaaaaaagcag-gcttaaacaatggcggagatacagtcaaa 3' and SEQ ID NO: 126; 5' ggggaccactttgtacaagaaagctgggttcacctccaagaggaacca 3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pPRP38. Plasmid pDONR201 was purchased from Invitrogen, as part of the Gateway® technology.

The entry clone comprising SEQ ID NO: 76 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 127) for constitutive expression was located upstream of this Gateway cassette.

Figure 9:
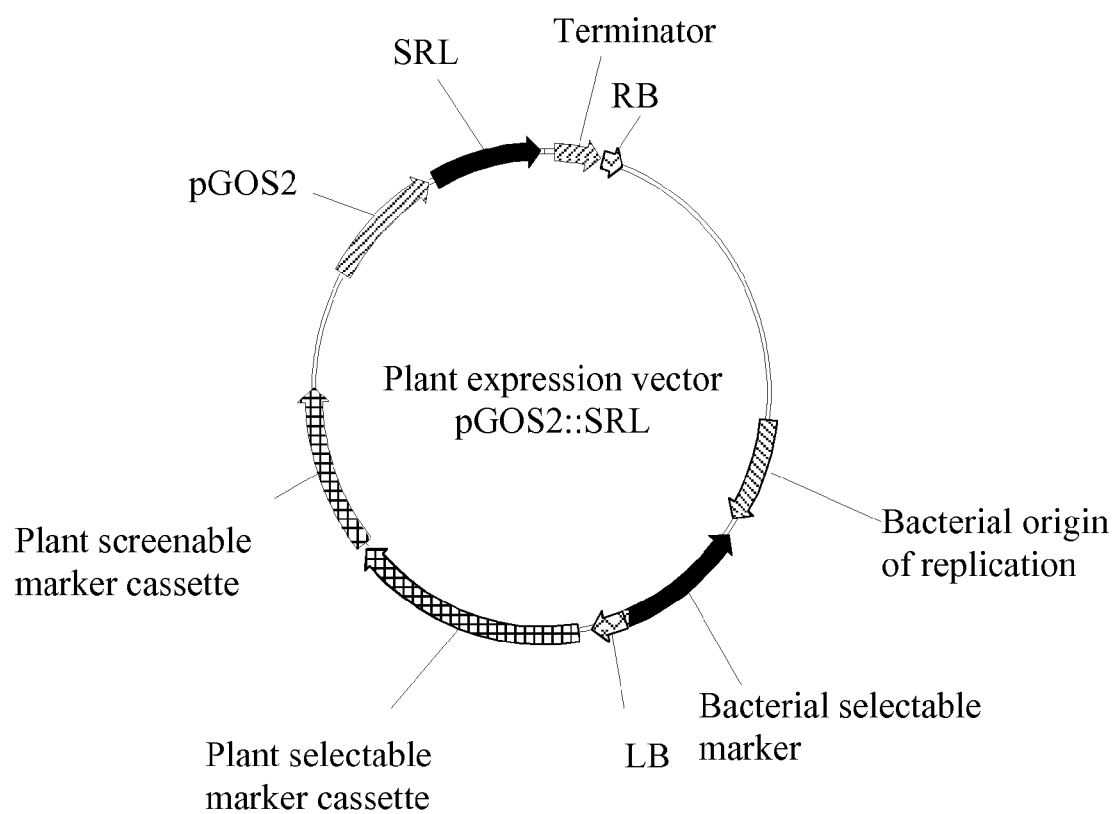
FIG. 9 represents the binary vector for increased expression in Oryza sativa of a PRP38-encoding nucleic acid under the control of a rice GOS2 promoter (pGOS2).

After the LR recombination step, the resulting expression vector pGOS2::PRP38 (FIG. 9) was transformed into *Agrobacterium* strain LBA4044 according to methods well known in the art.

```
Concerning GATA, the primers used were prm10133
(SEQ ID NO: 133; sense, start codon in bold):
5' GGGGACAAGTTTGTACAAAAAAGCAGGCTTAAACAATGTCTACTATC
TACATGAGCCA 3'
and prm10134 (SEQ ID NO: 134; reverse,complementary):
5' GGGGACCACTTTGTACAAGAAAGCTGGGTAGCTAGCTAGTTTTGATC
AGC 3',
``` which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pGATA-like. Plasmid pDONR201 was purchased from Invitrogen, as part of the Gateway° technology.

The entry clone comprising SEQ ID NO: 128 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 135) for root specific expression was located upstream of this Gateway cassette.

Figure 13:
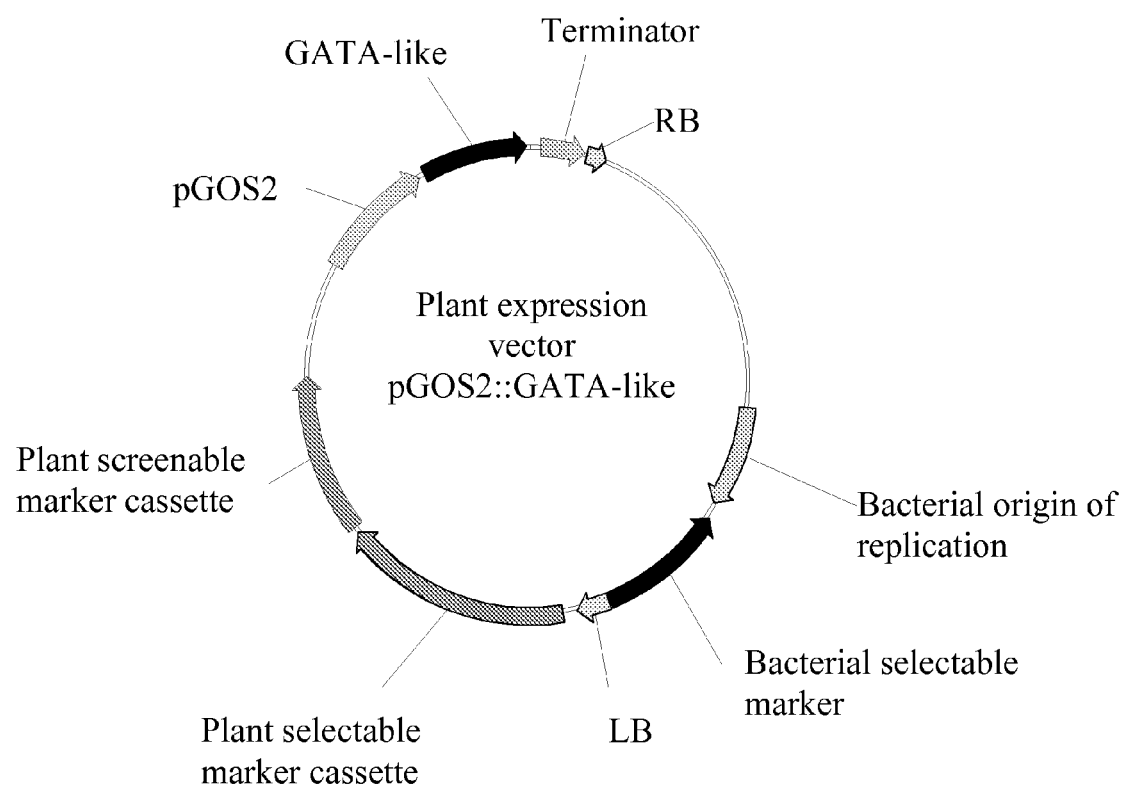
FIG. 13 represents the binary vector for increased expression in Oryza sativa of a GATA-like-encoding nucleic acid under the control of a rice GOS2 promoter (pGOS2::GATA-like).

After the LR recombination step, the resulting expression vector pGOS2::GATA-like (FIG. 13) was transformed into *Agrobacterium* strain LBA4044 according to methods well known in the art.

The nucleic acid sequence of SEQ ID NO: 177, used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm10106 (SEQ ID NO: 179; sense, start codon in bold): 5'-ggggacaagt ttgtacaaaaaagcaggcttaaacaat-gcttcaccattactacagc-3' and prm10107 (SEQ ID NO: 180; reverse, complementary): 5'-ggggaccactttgtacaa-gaaagctgggtcca acgctaatgctacact-3', which include the AttB sites for Gateway recombination. The amplified PCR fragment was purified also using standard methods. The further cloning procedure was as described above.

Concerning ADA2, the primers used were SEQ ID NO: 211: 5'-GGGGACAAGTTTGTACAAAAAAGCAG-GCTTAAACAATGGGTCGTTCGAAACTAGC-3' and SEQ ID NO: 212; 5'-GGGGACCACTTTGTACAA-GAAAGCTGGGTCATGTTAGGACCATGAAGCT ATG-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pAtADA2_1. Plasmid pDONR201 was purchased from Invitrogen, as part of the Gateway® technology.

The entry clone comprising SEQ ID NO: 181 was then used in an LR reaction with two destination vector used for *Oryza sativa* transformation. A first vector contained as functional elements within the T-DNA borders: a plant selectable marker; a screenable marker expression cassette; and a Gateway cassette intended for LR in vivo recombination with the nucleic acid sequence of interest already cloned in the entry clone. A rice HMGP promoter (SEQ ID NO: 213) for constitutive expression was located upstream of this Gateway cassette. On a second vector having same functional elements within the T-DNA borders as described above, a rice EXP9 promoter (SEQ ID NO: 214) was located upstream of the Gateway cassette.

Figure 18:
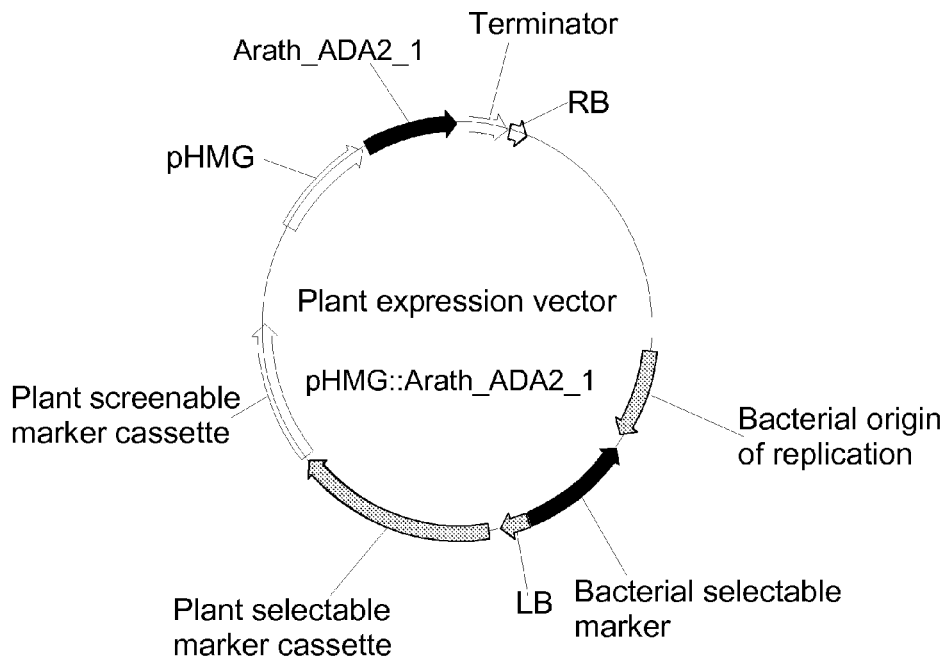
FIG. 18 and FIG. 19 represents the binary vectors for increased expression in *Oryza sativa* of an ADA2-encoding nucleic acid under the control of a rice HMGP promoter (FIG. 18) and under the EXP9 promoter (FIG. 19).
Figure 19:
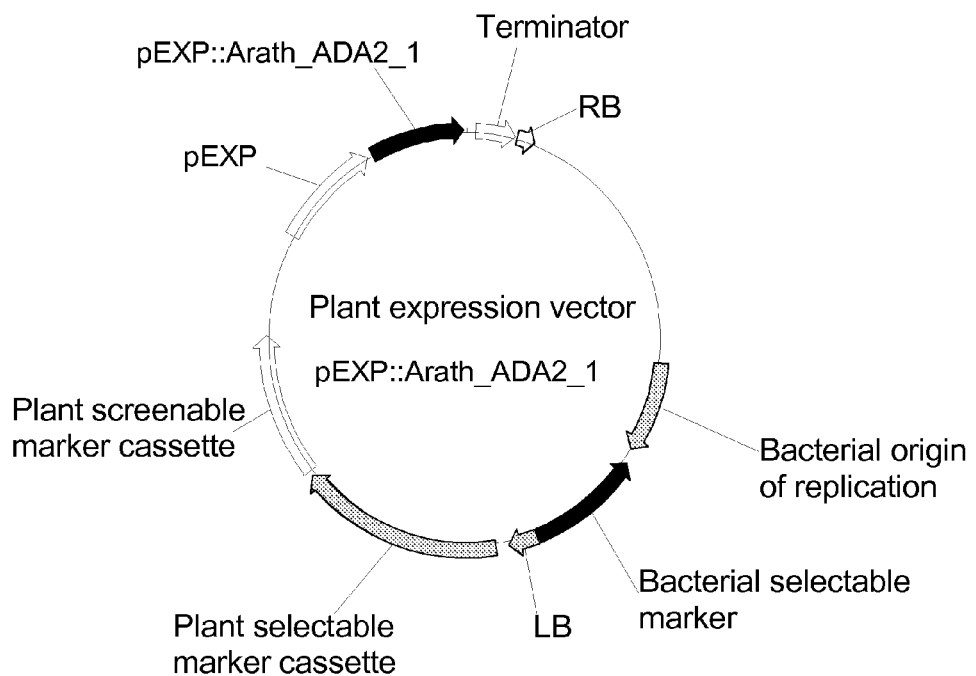

After the LR recombination step, the resulting expression vectors pHMG::*Arath*_ADA2_1 (FIG. 18) and pEXP9::*Arath*_ADA2_1 (FIG. 19) were transformed into *Agrobacterium* strain LBA4044 according to methods well known in the art.

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Concerning the WDR23-like polypeptide, the *Arabidopsis thaliana* cDNA encoding a WDR23-like polypeptide sequence as represented by SEQ ID NO: 216 was amplified by PCR using as template cDNA synthesized from mRNA extracted from different tissues of *Arabidopsis thaliana* grown under different conditions. The following primers, which include the AttB sites for Gateway recombination, were used for PCR amplification:

(v) Prm 09100 (SEQ ID NO: 274, sense):
5'-GGGGACAAGTTTGTACAAAAAAGCAGGCTTAAACAATGTTTTTTGGA
CCAAGTGAG-3'

(vi) Prm 09101 (SEQ ID NO: 275, reverse,
complementary):
5'-GGGGACCACTTTGTACAAGAAAGCTGGGTTGTGTAGAGAGACGCATC
AGT-3'

PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

Example 5A

Topology Prediction of the Polypeptide Sequences Useful in Performing the Methods of the Invention TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 129 are presented Table D3. The "plant" organism group has been selected, no cutoffs defined, and the predicted length of the transit peptide requested. The subcellular localization of the polypeptide sequence as represented by SEQ ID NO: 129 may be the cytoplasm or nucleus, no transit peptide is predicted.

TABLE D3

TargetP 1.1 analysis of the polypeptide sequence as represented by SEQ ID NO: 129

| | |
|---|---|
| Length (AA) | 353 |
| Chloroplastic transit peptide | 0.067 |
| Mitochondrial transit peptide | 0.169 |
| Secretory pathway signal peptide | 0.186 |
| Other subcellular targeting | 0.804 |
| Predicted Location | / |
| Reliability class | 2 |
| Predicted transit peptide length | / |

Many other algorithms can be used to perform such analyses, including:
- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark Example 6

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% HgCl2, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M patent U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MSO) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 μm J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 10⁸ cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 µg/ml MgCL2, and with 50 to 100 µg/ml cefotaxime and 400-500 µg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Concerning WDR23-like genes, Cotton (*Gossypium hirsutum* L.) transformation is performed using *Agrobacterium tumefaciens*, on hypocotyls explants. The commercial cultivars such as Coker 130 or Coker 312 (SeedCo, Lubbock, Tex.) are standard varieties used for transformation, but other varieties can also be used. The seeds are surface sterilized and germinated in the dark. Hypocotyl explants are cut from the germinated seedlings to lengths of about 1-1.5 centimeter. The hypotocyl explant is submersed in the *Agrobacterium tumefaciens* inoculum containing the expression vector, for 5 minutes then co-cultivated for about 48 hours on MS+1.8 mg/l KNO3+2% glucose at 24° C., in the dark. The explants are transferred the same medium containing appropriate bacterial and plant selectable markers (renewed several times), until embryogenic calli is seen. The calli are separated and subcultured until somatic embryos appear. Plantlets derived from the somatic embryos are matured on rooting medium until roots develop. The rooted shoots are transplanted to potting soil in the greenhouse. T1 seeds are produced from plants that exhibit tolerance to the selection agent and that contain a single copy of the T-DNA insert.

Example 6B

Expression Vector Construction Using the Nucleic Acid Sequence as Represented by SEQ ID NO: 215

The entry clone comprising SEQ ID NO: 215 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 272) for constitutive expression was located upstream of this Gateway cassette. A second destination vector for *Oryza sativa* transformation was also produced, with a rice metallothionein promoter (MT; SEQ ID NO: 273) for meristem-specific expression.

Figure 25:
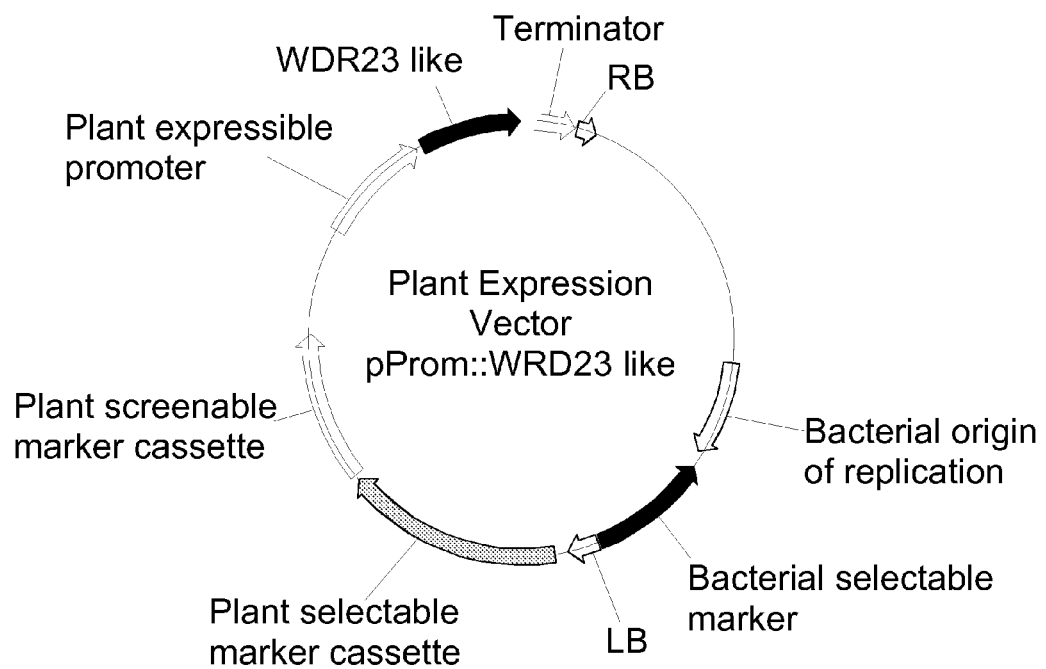
FIG. 25 shows the binary vector for increased expression in *Oryza sativa* of a nucleic acid sequence encoding a WDR23-like polypeptide under the control of a plant expressible promoter, such as a GOS2 promoter or metallothionein promoter, both from rice.

After the LR recombination step, the resulting expression vector pGOS2::WDR23-like and pMT::WDR23-like (FIG. 25) were independently transformed into *Agrobacterium* strain LBA4044 according to methods well known in the art.

Example 7

Phenotypic Evaluation Procedure 7.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions (non-stress conditions) were of shorts days (12 hours light), 28° C. in the light and 22° C. in the dark, and a relative humidity of 70%. Frequent watering was applied to satisfy plant water and nutrient needs in order to grow and develop with a healthy appearance.

From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds are grown in potting soil under normal conditions until they approached the heading stage. They were then transferred to a "dry" section where irrigation was withheld. Humidity probes were inserted in randomly chosen pots to monitor the soil water content (SWC). When SWC went below certain thresholds, the plants were automatically re-watered continuously until a normal level was reached again. The plants were then re-transferred again to normal conditions. The rest of the cultivation (plant maturation, seed harvest) was the same as for plants not grown under abiotic stress conditions. Growth and yield parameters are recorded as detailed for growth under normal conditions.

Nitrogen Use Efficiency Screen

Rice plants from T2 seeds are grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters are recorded as detailed for growth under normal conditions.

7.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P values were obtained by comparing likelihood ratio test to chi square distributions.

7.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants were harvested. Growth and yield parameters are recorded as detailed for growth under normal conditions.

Reduced Nutrient (Nitrogen) Availability Screen

Plants from six events (T2 seeds) are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Example 8

Results of the Phenotypic Evaluation of the Transgenic Plants

The results of the evaluation of transgenic rice plants expressing Orysa_PATL_1 (SEQ ID NO:1) nucleic acid from the GOS2 promoter and grown in a green house under non-stress conditions (Example 7) are presented below. An increase of at least 3% was observed for the seed weight (total seed weight), number of filled seeds, and plant height (Table D1).

TABLE D1

Result of evaluation of performance of transgenic plants (T2 plants) transformed with pGOS2::SEQ ID NO: 1.

| Yield-related trait | % increase in the transgenic plant (plants transformed with pGOS2::Orysa_PATL_1) compared to the control nullizygous plant |
|---|---|
| Total Seed Weight | 8 |
| Harvest Index | 5 |
| Plant Height | 3 |
| Number of Filled Seeds | 7 |

The results of the evaluation of transgenic rice plants expressing a AtPRP38_1 (SEQ ID NO:76) nucleic acid grown in a green house under non-stress conditions (Example 7) are presented below. An increase of at least 5% was observed for aboveground biomass (AreaMax), emergence vigour (early vigour), total seed yield, number of filled seeds, fill rate, harvest index, and number of seeds per plant (Table D2).

TABLE D2

Result of evaluation of performance of transgenic plants transformed with pGOS2::PRP38.

| Yield-related trait | % increase in the transgenic plant compared to the control nullizygous plant |
|---|---|
| Above ground area | 10 |
| Emergence Vigour | 38 |
| Total seed weight | 18 |
| Number of filled seeds | 18 |
| Seed filling rate | 7 |
| Harvest Index | 8 |
| Total number of seeds | 11 |

Evaluation of transgenic rice plants expressing the GATA-like nucleic acid represented by SEQ ID NO: 128 under non-stress conditions revealed an increase of Thousand Kernel Weight (all six events, overall increase of 9.1%, p-value: 0.00001). No significant changes were observed for other yield parameters.

Evaluation of transgenic rice plants expressing the GATA-like nucleic acid represented by SEQ ID NO: 177 under non-stress conditions revealed an increase of total weight of seeds (four lines out of six, overall increase of 16.9%, p-value: 0.00001) and number of filled seeds (four lines out of six, overall increase of 16.0%, p-value: 0.00001). No significant changes were observed for other yield parameters.

The results of the evaluation of transgenic rice plants expressing Arath_ADA2_1 (SEQ ID NO: 181) nucleic acid from either the pHMG or the pEXP promoters and grown in a green house under non-stress conditions (Example 7) are presented below. An increase of at least 3% was observed for the seed weight (total seed weight), number of filled seeds, seed filling (fill rate), number of flowers per planicle and harvest index (Table D4).

TABLE D4

Result of evaluation of performance of transgenic plants (T1 plants) transformed with pHMG::SEQ ID NO: 181 and with pEXP::SEQ ID NO: 181.

| Yield-related trait | % increase in the transgenic plant compared to the control nullizygous plant (plants transformed with pHMG::Arath_ADA2_1) | % increase in the transgenic plant compared to the control nullizygous plant (plants transformed with pEXP::Arath_ADA2_1) |
|---|---|---|
| Total seed weight | 21 | 9 |
| Number of filled seeds | 21 | 8 |
| Seed filling rate | 12 | 10 |
| Nr flowers per panicle | 4 | 3 |
| Harvest Index | 23 | 8 |

Example 9

Results of the Phenotypic Evaluation of the Transgenic Rice Plants Expressing the Nucleic Acid Sequence Encoding a WDR23-Like Polypeptide as Represented by SEQ ID NO: 216, Under the Control of a Constitutive Promoter The results of the evaluation of T1 and T2 generation transgenic rice plants expressing the nucleic acid sequence encoding a WDR23-like polypeptide as represented by SEQ ID NO: 216, under the control of a GOS2 promoter for constitutive expression, are presented below.

There was a significant increase in the total seed yield per plant, in the seed filling rate, in the number of filled seeds, in the harvest index, and in the Thousand Kernel Weight (TKW) of the transgenic plants compared to corresponding nullizygotes (controls), as shown in Table D5, in both T1 and T2 generation phenotypic analysis.

TABLE D5

Results of the evaluation of T1 and T2 generation transgenic rice plants expressing the nucleic acid sequence encoding a WDR23-like polypeptide as represented by SEQ ID NO: 216, under the control of a GOS2 promoter for constitutive expression.

| Trait | Overall average % in T1 generation | Overall average % in T2 generation |
|---|---|---|
| Total seed yield per plant | 84 | 16 |
| Seed filling rate | 73 | 11 |
| Number of filled seeds | 95 | 7 |
| Harvest index | 93 | 13 |
| TKW | 8 | 4 |

Example 10

Results of the Phenotypic Evaluation of the Transgenic Rice Plants Expressing the Nucleic Acid Sequence Encoding a WDR23-Like Polypeptide as Represented by SEQ ID NO: 216, Under the Control of a Meristem-Specific Promoter The results of the evaluation of T1 and T2 generation transgenic rice plants expressing the nucleic acid sequence encoding a WDR23-like polypeptide as represented by SEQ ID NO: 216, under the control of a metallothionein MT promoter for meristem-specific expression, are presented below.

There was a significant increase in the total seed yield per plant, in the seed filling rate, in the number of filled seeds, in the harvest index, and in the Thousand Kernel Weight (TKW) of the transgenic plants compared to corresponding nullizygotes (controls), as shown in Table E, in both T1 and T2 generation phenotypic analysis.

TABLE E

Results of the evaluation of T1 and T2 generation transgenic rice plants expressing the nucleic acid sequence encoding a WDR23-like polypeptide as represented by SEQ ID NO: 216, under the control of an MT promoter for meristem-specific expression.

| Trait | Overall average % in T1 generation | Overall average % in T2 generation |
|---|---|---|
| Total seed yield per plant | 18 | 7 |
| Seed filling rate | 17 | 6 |
| Number of filled seeds | 10 | 5 |
| Harvest index | 15 | 8 |
| TKW | 2 | 0 |

SEQUENCE LISTING (288 sequences)

SEQ ID NO: 1 - DNA, 1842 bp, Oryza sativa
atggcggaggagccacagccagaggccgcgcccgccgcggtggcggcgacgaccgaggtggcggtggcggagaaggcgcccgtggaggcggagaaggagaagaaggtggaggaggagacgccggcggtggaggccgaggcgaaggaggagaagaaggatgaggcggcggcggcggcggcggcgggaggtgatgaggccggggcgatagaggggaccggatcgttcaaggaggagagcaacctggtggcggacttgcctgacccggagaagaaggcgctcgatgagttcaagcagctgatcgccgccgccctcgccgcctgtgagttcaatctgcctccccctccgccgcctcccaaggcgaaggttgaagccgccgttgaggagaccaaggcggaggagaccaaggccgaggaggaacccaaggctgaggagccggccaaggaggaggagcccaaggccgaggtggcggcggcggcggcggcgccgccggaggcaggaaccgaggagccgaaggcggaggcgtcgtccgaagaggccaagaccgaggagccgaaggccgaggcggcggccgacgagccggccaaggaggagtccaaagctgaggcggcgccggctgaggaagccaagccggccgagccggagccggaggagaagaccgtcgtggtcaccgaggaagaggcggccaccaagacggtggaagcgatcgaggaaaccgtcgtgcccgctgctgctgcgcctgctgccgccgccacggaggaagccgcggcgccggaaccggaggtgcaggcggcggcggcgcctgagcccgtgttgatctggggcgtgcccctggtaggcgacgacgagcgcaccgacacggtgctcctcaagttcctgcgcgcgcgcgagttcaaggtgaaggaggccatggcgatgctcaggtcggccgtgctgtggcgcaagcgcttcggcatcgagtccctcctcgacgccgacctcgccctgccggagctcgacagcgtggtgttctaccgcggcgccgaccgcgagggccaccccgtgtgctacaacgtctacggcgaattccaggacaaggacctgtacgagaaggcattcggcgacgaggagaagcgggagcgcttcctcaagtggcgcatccagctgctggagcgcggcatcctgtcgcagctcgacttctcgcccagtggcatctgctccatggttcaggtcacagacctcaagaactcgccacctatgctcggcaagcaccgcgccgtcacccgccaggccgttgctctgctccaggacaactaccccgagttcatcgccaagaaggtgttcatcaatgtgccatggtggtatctcgctgccaacaaaatgatgagcccgttcctcacgcagcgtaccaagagcaagttcatttttgccagcccagccaaatcagctgagaccctcttcagatatatcgcaccagagcaagtccctgtccaattcggaggtctcttcaaggaagatgatcctgagttcaccacctcagacgccgttaccgagctcactatcaaaccttcatcgaaagaaaccgttgagattcctgtcactgagaattccacgattggatgggagctccgggtgcttggatgggaggtgagctacggagcagagttcactcctgatgccgagggtggatacacagtcatcgtgcagaaaacgaggaaggtgcctgcaaatgaggaaccaatcatgaaaggcagcttcaaggttggcgagccaggaaagattgtgctaacgatcaacaaccctgcatcaaagaagaagaagctcctctacagatccaaggtcaagagcaccagtgagtccgtttga

SEQ ID NO: 2 - protein, 613 aa, Oryza sativa
MAEEPQPEAAPAAVAATTEVAVAEKAPVEAEKEKKVEEETPAVEAEAKEEKKDEAAAAAAAGGDEAGAIEGTGSFKEESNLVADLPDPEKKALDEFKQLIAAALAACEFNLPPPPPPPKAKVEAAVEETKAEETKAEEEPKAEEPAKEEEPKAEVAAAAAAPPEAGTEEPKAEASSEEAKTEEPKAEAAADEPAKEESKAEAAPAEEAKPAEPEPEEKTVVVTEEEAATKTVEAIEETVVPAAAAPAAAATEEAAAPEPEVQAAAAPEPVLIWGVPLVGDDERTDTVLLKFLRAREFKVKEAMAMLRSAVLWRKRFGIESLLDADLALPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFKEDDPEFTTSDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKVKSTSESV

SEQ ID NO: 3 - DNA, 1308 bp, Oryza sativa
atgtctccgaccgccaccccatcccccgcgcccgccgcggtggcggcagcgcccaagccgccgccgtcggggacgggggcgaagcgcagcctgatgtcgtcgctgatggaggccaccgcgctgctcaggtcgtcgtcgttcaaggaggactcgtacgtggcgtccgcgctcccggcgtccgacctccgcgcgctcgccgacctcagggcgctgctgtccacgcacccggacccaatctccatctggggcgtgccgctcaacccggcgccgccccagggcggggagggggccccggccccggccgccgccgccgacgagcgcgccgacgtcgtgctgctcaagttcctccgcgcgcgggacttccgcgtccgcgacgcgcacgccatgctgctccgctgcgccgcgtggcgggccgagttccgcgccgacgccgtgctggacgaggacctcgggttcaaggacctggagggggtcgtcgcctacatgcacggctgggaccgggagggccacccggtctgctacaacgcctacggcgtcttcaaggacagggacatgtacgaccgcgtcttcggcgacggcgagcgcctcgcccgcttcctccgctggcgcgtccaggtcatggagcgcggcgtccgcgcgctccacctccgccccggcggcgtcaacgccatcatccaggtcaccgacctcaaggacatgcccaagcgcgagctccgcgccgcgtccaaccagatcctctccctcttccaggacaactaccctgagatggtcgcgcgcaaggtgttcatcaacgtgccctggtacttctcggtgctgttctccatgatctcgccgttcctcacggagcgcaccaagagcaagttcgtcatcgcgcgcgagggcaacgtcgccgagacgctcttcaagttcatccggccggagctggtgccggtgcagtacggcgggctgagccgcgccggcgacctggagaacggcccgccgaagccggcgtccgagttcaccatcaagggcggcgagaaggtcttcctagagatcgacggcatcgaggccggcgcgacgataacgtgggacctggtggtgggcgggtgggagctggagtacggcgcggagtacgtgccggcggcggaggacagctacacgctgtgcgtggagcggacgaggaaggtgccggccgccgccgacgagccggtgcacaacgccttcacggcgagggaggccggcaagatggtgctctccatcgacaactccggctcccggaagcggaaggtcgccgcctaccggtacttcgtgcgcaagccgtcggcgtag

SEQ ID NO: 4 - protein, 435 aa, Oryza sativa
MSPTATPSPAPAAVAAAPKPPPSGTGAKRSLMSSLMEATALLRSSSFKEDSYVASALPASDLRALADLRALLSTHPDPISIWGVPLNPAPPQGGEGAPAPAAAADERADVVLLKFLRARDFRVRDAHAMLLRCAAWRAEFRADAVLDEDLGFKDLEGVVAYMHGWDREGHPVCYNAYGVFKDRDMYDRVFGDGERLARFLRWRVQVMERGVRALHLRPGGVNAIIQVTDLKDMPKRELRAASNQILSLFQDNYPEMVARKVFINVPWYFSVLFSMISPFLTERTKSKFVIAREGNVAETLFKFIRPELVPVQYGGLSRAGDLENGPPKPASEFTIKGGEKVFLEIDGIEAGATITWDLVVGGWELEYGAEYVPAAEDSYTLCVERTRKVPAAADEPVHNAFTAREAGKMVLSIDNSGSRKRKVAAYRYFVRKPSA

SEQ ID NO: 5 - DNA, 1758 bp, Oryza sativa
atggctgaggaggcgaagcaagagacccccgccgccgccgaggtggtggtggtggagaaggccgacgaggtggtggcggtggagaaggccgtggaggtggaggcggaggagaagaagttggcggagcaggaggaggaggaggagaagaaggcggaggaggcggaggaggccgctgggggcgatgaggcggcggtgatcgaggggacggggtcgttcaaggaggagagcaacctcgtctccgagctccccgacccggagcgcacggcgctcgcccagctcaaggagctcgtcgccgccgcgcttgccgccggcgagtttgaccttcccccgccgccgccgcctccaccggccaaggcggaggagccggccaaggaggaggaacccaaggccgccgaggcccccgccgccgaggagcccaaggccgaggccgaggctgaggctgaggccgccgccacggaggagcccaagaccgaggagcccaagaccgaggagcccgccaaggaggaggagcccaaggcggcggcggcggctgcggccgaggagcccaaggcggaggcggcggcggaggaggccaagccggccgagccggaaacggaggagaagaccgtcgtggtcaccgaggatgaaggcaccagcaagacggtggaggccatcgaggagaccgtcgtcgtcgccgccccggccgcggccgcggaagccgaggctgcggcgccgaaggaggagctgatatggggcgtgccgctgaccggcgacgacgagcgcacggacaccgtgctgctcaagttcctccgcgccagggagttcaaggtgaaggaggccatggcgatgctcaaggcggcggtgctgtggcgcaagcgcttcggcatcgacgccgtcctggccgccgacctcggcctgccggagctcgagaacgtggtgttctaccgcggcgccgaccgcgagggccaccccgtctgctacaacgtctacggcgagttccaggacaaggacctctacgagaaggccttcggcgacgaggagaagcgggagcgattcctcaagtggcgcatccagctcctcgagcgcggcatcctcgaccagctcgacttctcccccagcggcatctgctccatggtgcaggtcaccgacctcaagaactcgccgcccatgctcggcaagcaccgcaccgtcacccgccaggcgctcgccctgctccaggacaactaccccgagttcatcgccaagaagattttcatcaacgtgccatggtggtacattgcggctaacaaaatggtgagtccgttcctcacacaacgcaccaagagcaagatcatcttttgcaccgcagccaagtctgcagagacccttttcagatacattgctcctgagcaagtccctgtccaattcggaggcctctacaaagaggatgacaccgagttctccacctcagatgctgtcacagagcttccgatcaaaccttcatccaaagaaactgttgagattcctgctactgagaactccacggttgtgtgggagcttcgggtgcttgggtgggaggtgagctacggtgcagagttcacccctgatgcagagggtggctacactgtcattgtgcagaagacaaggaaggtgcccgccaatgaagagccgatcatgaagggcagcttcaaggttggcgagcctggcaagatcgtcctcacagtcgacaacgcagcatccaagaagaagaagcagcttctttaccgattcaaggtcaagagctcctctgaatctgcctaa

SEQ ID NO: 6 - protein, 585 aa, Oryza sativa
MAEEAKQETPAAAEVVVVEKADEVVAVEKAVEVEAEEKKLAEQEEEEEKKAEEAEEAAGGDEAAVIEGTGSFKEESNLVSELPDPERTALAQLKELVAAALAAGEFDLPPPPPPPPAKAEEPAKEEEPKAAEAPAAEEPKAEAEAEAEAAATEEPKTEEPKTEEPAKEEEPKAAAAAAAEEPKAEAAAEEAKPAEPETEEKTVVVTEDEGTSKTVEAIEETVVVAAPAAAAEAEAAAPKEELIWGVPLTGDDERTDTVLLKFLRAREFKVKEAMAMLKAAVLWRKRFGIDAVLAADLGLPELENVVFYRGADREGHPVCYNVYGEFQDKDLYEKAFGDEEKRERFLKWRIQLLERGILDQLDFSPSGICSMVQVTDLKNSPPMLGKHRTVTRQALALLQDNYPEFIAKKIFINVPWWYIAANKMVSPFLTQRTKSKIIFCTAAKSAETLFRYIAPEQVPVQFGGLYKEDDTEFSTSDAVTELPIKPSSKETVEIPATENSTVVWELRVLGWEVSYGAEFTPDAEGGYTVIVQKTRKVPANEEPIMKGSFKVGEPGKIVLTVDNAASKKKKQLLYRFKVKSSSESA

SEQ ID NO: 7 - DNA, 1554 bp, Oryza sativa
atggcggtggaggtcgtgtctgagggtgcggcggccgccgcggcggaggtggcggcgccggagacgaaggaggtgaccgcgaaggcggcggcggatgaggcggtgacgctggctgccgtcgtgtccaagaacgcgtcgttcagggaggagagcaacttcctggatgatctcaaggacggcgagaggaaggcgttggctgagctccgtgccaaggttgaggaggccatcgtcgacggcaagctgttcgatgacggcaaggtggaggccaagaagaaggccgcggcggcggaggaggagaaggcggtggaggaggccgccggtgagaagaaagatggcgaggagaagaaagaggaggaggagccggtgacggaggagaagaaggaagaggagcaaggcgaggaggaggaggagcccaagaaagaggaagccgacgagggcgagaaggaggagaagccggcggaggaggaggcggcggcggttgtggacaaggacatcgctctgtggggcgtgccgctgctgccgagcaagggcgacgacgccaccgacgtcgtcctcctcaagttcctccgcgcgcgcgacttcaaggccggcgccgccttcgacatgctccgcaagacgctccactggcgcagggagtggaagggcttcgccgccggcaccgacgacgacgacgacggcgaggcgctcccggcggagctcgccgacgcgtgctacctcgacggcgcggacagggagggccacccggtgtgctacaacgcgctcggcgtgttcgccgacgacgccgtgtacaagaaggcgctcggcacggaggaaggcaaggcgaggttcctccggtggagggtgcgcgccatggagagccacgtggccaagctcgacctcaggcccggcggcgtcgcgtcgctgctgcaggtgacggacctcaagaactcgccggggccggccaagaaggacctccgcgtcgccatgaagcaggtgctcgacctcttccaggacaactaccctgagctcgtcgcaagaaacattctgatcaatgtgccgttctggtactacgcgttcagcaccctcttctacccgttcatgacgcagaggaccaagagcaagttcgtcattgctcggccctccaaggtcaccgagaccctcctcaagtacattcccattgaagccattccagtgaagtacggtggtctgaagcgcgacgacgacaccgagttctcggcagaggacagtgaagtcacagagctcgttgtcaaggcaagctccaccgaaaccatcgagatcgaagccacagagggtgacactacgctgacatgggacctgaccgtgctgggatgggaggtgaactacaaggaggagttcgtgccgagcgaggagggctcgtacaccgtcatcgtcaagaaggggaagaagatggggtcgtcggaggcggcggtccgcaactcgttccgcgccggcgagccggggaaggtggtcctcaccgtcgagaacctgacgcacaggaagaagaaggtgctgttcaggcacaaggccaagagcgcctgtgccaaggagtgctga

SEQ ID NO: 8 - protein, 517 aa, Oryza sativa
MAVEVVSEGAAAAAAEVAAPETKEVTAKAAADEAVTLAAVVSKNASFREESNFLDDLKDGERKALAELRAKVEEAIVDGKLFDDGKVEAKKKAAAAEEEKAVEEAAGEKKDGEEKKEEEEPVTEEKKEEEQGEEEEEPKKEEADEGEKEEKPAEEEAAAVVDKDIALWGVPLLPSKGDDATDVVLLKFLRARDFKAGAAFDMLRKTLHWRREWKGFAAGTDDDDDGEALPAELADACYLDGADREGHPVCYNALGVFADDAVYKKALGTEEGKARFLRWRVRAMESHVAKLDLRPGGVASLLQVTDLKNSPGPAKKDLRVAMKQVLDLFQDNYPELVARNILINVPFWYYAFSTLFYPFMTQRTKSKFVIARPSKVTETLLKYIPIEAIPVKYGGLKRDDDTEFSAEDSEVTELVVKASSTETIEIEATEGDTTLTWDLTVLGWEVNYKEEFVPSEEGSYTVIVKKGKKMGSSEAAVRNSFRAGEPGKVVLTVENLTHRKKKVLFRHKAKSACAKEC

SEQ ID NO: 9 - DNA, 1058 bp, Brassica napus
gcgacgtcgttttactgaagttcctacgcgctagggacttcaaggtgaaagattcgctggcaatgctcaagaacacagtcaagtggagaagggagttcaagatcgacgagttggtcgatgaagactttgtggatgatcttgacaaggtcgtgttcatgcacggacacgaccgtgaaggccacccggtgtgttacaatgtctacggcgagttccagaacaaggagctttacaacaagacgttctccgatgaggagaagaggaagcatttcttgaggacgaggattcagttcttggagaggagtataaggaagctagacttcagctccggtggtgtttccaccatttttcagattaatgatatgaagaactctccggggttggggaagaaagagcttagatcggcgaccaagcaagccgtgcagttgcttcaggacaattaccctgagtttgtcttcaaacaggccttcatcaatgttccctggtggtaccttgtgttttacactgtgattggtccgttcatgacaccaagatcaaagagcaagttggtgtttgctggtccgtcaagatcagccgaaactcttttcaaatacatatcgcccgaacaagtcccggtacaatacggaggattgagtgtagatccttgtgactgcaatccagacttctctttggatgatccagcctcagaggtcattgttaagcctggaacaaagcaaactgttgagatcataatctatgagaaatgtgagattgtgtgggagataagggtaattggatgggaagtgagctacaaggcagagtttgtgcctgaagagaaagatgcttatacggtggttgtacagaaaccgaggaagatgaaaccattcgatgaaccggtgttaacccagagcttcaaagtgaatgagcttggcaaggttttactcactgtagacaacccaacctctaagaagaagaagctcgtttacaggttcaatgtcaaaccactctgaagtgagatgtcttctttgtgtttttgtatatgtgagtgtttggtatatcatatcatatcattttgtatttgt

SEQ ID NO: 10 - protein, 307 aa, Brassica napus
MLKNTVKWRREFKIDELVDEDFVDDLDKVVFMHGHDREGHPVCYNVYGEFQNKELYNKTFSDEEKRKHFLRTRIQFLERSIRKLDFSSGGVSTIFQINDMKNSPGLGKKELRSATKQAVQLLQDNYPEFVFKQAFINVPWWYLVFYTVIGPFMTPRSKSKLVFAGPSRSAETLFKYISPEQVPVQYGGLSVDPCDCNPDFSLDDPASEVIVKPGTKQTVEIIIYEKCEIVWEIRVIGWEVSYKAEFVPEEKDAYTVVVQKPRKMKPFDEPVLTQSFKVNELGKVLLTVDNPTSKKKKLVYRFNVKPL

SEQ ID NO: 11 - DNA, 1092 bp, Helianthus annuus
tcccgcgtcgacgatttcgtatgatcttgagaaagttgtgattaatcatggctttgataaagaaggacacccagattaatataatgtgtatggtgagtttcagaacaaagagttgtataataaaatgtttagtgataatgaaggaagattgaggtttttaaggtggagaattcagtatcttgaaaggagtataaggaagttggattttaggcctggtggggtgaatactatttttcagattagtgatttgaagaactcgcctggaccggcgaaacgggagcttcggttagccaccaggcaagctctgcagattctgcaggataactaccctgaatttgtggcaaaacaggttttcatcaatgccccttggtggtatttagctttctatacaatgattagtccattcatgactcaaaggactaaaagcaagtttgtattcgctagcacggccaagacacccgaaacccttttcaaatacgtgaatccggagcacgtaccaattcagtacggcgggttaagcgtagattactgcgattgcaatcccgaattcacaattgatgatccggcttcagtggtcaccgttaaaccagctaccaagcagaccgtggagattatagtaaacgagaaatgcttatttgtatgggagctacgtgtagtcggttgggaggtgagctatagtgctgaatatgtgccgaacaacgaaagccattacacgataatcatacaaaaggctagaaagatgactccaaccgatgaaccagtgatcagtcacagtttcaagatcagtgagcttggtaagatacttctaaccgtcgacaacccgacctccaagaagaaaacactgctctataggttcaaggtgaacccgctttccgaatagaataacgtacatcaaggatcgacagacagacagtcatatgatcgcgcgagtttattatttatttatgtttttatttgtttctttttggtagttgttatgagtttgggtccatggtgttgtgtttgggttcaaaaggcttgtggtttttgtattaatgtcttttggctttcacaaaatcggttgctgaaatttgactgatcgagttctatttt

SEQ ID NO: 12 - protein, 251 aa, Helianthus annuus
MFSDNEGRLRFLRWRIQYLERSIRKLDFRPGGVNTIFQISDLKNSPGPAKRELRLATRQALQILQDNYPEFVAKQVFINAPWWYLAFYTMISPFMTQRTKSKFVFASTAKTPETLFKYVNPEHVPIQYGGLSVDYCDCNPEFTIDDPASVVTVKPATKQTVEIIVNEKCLFVWELRVVGWEVSYSAEYVPNNESHYTIIIQKARKMTPTDEPVISHSFKISELGKILLTVDNPTSKKKTLLYRFKVNPLSE

SEQ ID NO: 13 - DNA, 1409 bp, Zea mays
cggccgcgctcccggcgtccgagctccgcgcgctcgccgacctcaaggcgctgctcgccacccacccggaccccatctccatctggggcgtcccgctgaaccctcgctcccctcccgccgcggcggacgacgccgccccggtcgacgagcgcgccgacgtggtgctcctcaagttcctccgcgcgcgggacttccgcgtccgcgacgcccacgccatggtgctccgctgcgccgcctggcgcgccgagttcggcgccgacgccgtgctggacgaggagctgggcttcaaggacctggagggcatcgtcgcctacatgcacggctgggaccgcgacggccaccccgtctgctacaacgcctacggcgtcttcaaagacagggacatgtacgagcgcgtcttcggcgacggcgaccgcctcgcgcgcttcctccgctggcgcgtccaggtcatggagcgtggcgtgcgcgcgctcaccctgaggcccgggggcgtcaacgccatcatacaggtcaccgacctcaaggacatgccaaagcgggagctcagagccgccagcaaccagatcctctccctcttccaggacaactacccggagatggtagcgcggaaggtgttcattaacgtgccgtggtacttctccgtgctcttctccatgatctcgcccttcctcacggagcgcaccaagagcaagttcgtcatcgcgcgcgagggcaacgtcgccgagacactctacaagttcatccggccggagctggtgcctgtgcagtacggcgggctgagccgcaccggtgacctcgagaacggaccaccgaagccggcgtccgagttcaccatcaagggtggcgagaaggtcttcctggagatcgacggtatcgaggccggtgcaacgataacgtgggatctggtcgtcgggggctgggacctcgagtacggagccgagtacgtgccggcggccgaggacagctacacgctctgcgtggagaagacgaggatggtctcggccaccgccgaggagcccgtgcacaatgccttcacggctagggaagccggcaagatggtgctgtccatagacaattctggttcccggaagcgcaaggttgccgcctacaggtacttcgtgcgcaagtcgtcggcgtaggcatgctgatgtcttgtggtggtcgtcgcggccggcaccttgccggcaggtagccgcgagggggaggttaacgtggaacaactggtgaagtgtttacttgggcttgtgggatttggtggggagaggtcaagttaggctgtttaattattagtgctataacgacatgcatgtattatgccatatgtagaatataatgtactccgtaagagctgttgcacttttgtcatcaccactgttataaagctaatgatgagttaagttttttgggct

SEQ ID NO: 14 - protein, 307 aa, Zea mays
MVLRCAAWRAEFGADAVLDEELGFKDLEGIVAYMHGWDRDGHPVCYNAYGVFKDRDMYERVFGDGDRLARFLRWRVQVMERGVRALTLRPGGVNAIIQVTDLKDMPKRELRAASNQILSLFQDNYPEMVARKVFINVPWYFSVLFSMISPFLTERTKSKFVIAREGNVAETLYKFIRPELVPVQYGGLSRTGDLENGPPKPASEFTIKGGEKVFLEIDGIEAGATITWDLVVGGWDLEYGAEYVPAAEDSYTLCVEKTRMVSATAEEPVHNAFTAREAGKMVLSIDNSGSRKRKVAAYRYFVRKSSA

SEQ ID NO: 15 - DNA, 1160 bp, Glycine max
accatgctgaagaacacgatccagtggaggaaggagtttgggatggaggagctgatggaagagaagctcggggatgagttggagaaggtggtgttcatgcacggctttgacaaggagggtcaccctgtgtgttacaacatatatgaggagttccagaacaaggagttgtacaagaagactttttctgatgaggagaagagggagaagttcctgaggtggagaattcagttcctggagaagagtataaggaagcttgatttcaaccctggtggcatatgcaccattgttcatgttaatgacctcaagaactctcctggacttgccaagtgggaacttagacaagccaccaaacatgccctacaattgcttcaagacaattaccctgaatttgttgccaaacaggtttttattaatgtgccttggtggtacctggcagtgaataggatgataagcccttttcttactcagaggactaaaagcaagtttgtctttgctgggccttccaaatcaacggaaacccttttgagatacatagctccggagcagcttcccgtgaagtacggtggactaagcaaagatggggagttcggaaatatcgatgctgtcacagaaatcacagtgaggccggcagcaaaacatacagtggaattttcagttactgagaactgcttactctcttgggagcttagagtaataggatgggaagtaagttatggcgcagaatttgtgccaagctcagaaggaagctacacagtaattgtccagaaggctaggaaggttgcttcatcagaagaaccagttctttgcaacagttttaaggttggtgaacctgggaaagttgttctcaccattgacaacacaagctctaagaagaagaagctcttgtatcgcttgaagaccaagccttccccttctgactaaaatcatcattgttatgtgtatgtgcaagtgggaaggggaagaacagtgccagaattgtttgcttacattcctgcatcaacttctaccaagacaccagtgcttcaaagattaactttccagctgttcatatatgaatataaagtttttgtttttaattttttggcctttttgttttgatgattattatgtgttcaaccatattatataattatatatacctctttctgtgtttttcttgc

SEQ ID NO: 16 - protein, 305 aa, Glycine max
MLKNTIQWRKEFGMEELMEEKLGDELEKVVFMHGFDKEGHPVCYNIYEEFQNKELYKKTFSDEEKREKFLRWRIQFLEKSIRKLDFNPGGICTIVHVNDLKNSPGLAKWELRQATKHALQLLQDNYPEFVAKQVFINVPWWYLAVNRMISPFLTQRTKSKFVFAGPSKSTETLLRYIAPEQLPVKYGGLSKDGEFGNIDAVTEITVRPAAKHTVEFSVTENCLLSWELRVIGWEVSYGAEFVPSSEGSYTVIVQKARKVASSEEPVLCNSFKVGEPGKVVLTIDNTSSKKKKLLYRLKTKPSPSD

SEQ ID NO: 17 - DNA, 2212 bp, Triticum aestivum
ccacgcgtccgctctccccctctccctcctgctctatctttctcaccgcaaaagcttgaaacaccccgcggagatggcagaggagccgcagccacaggccgccgccgcccccgccgccgcggccacggaggtggtcgtcgccgagaaggcgccggcggaggtggagaagaaggccgaggagcccgcggcggaggcggaggccgaggagacggccgccgttgccgacgacgggggcgccgtcgaggccaccggctctttcaaggaggagagcaacctcgtcgccgacctgcctgacccggagaagaaggcgctcgacgagttcaaggagctgatcgtcgccgcgctcgccgccggtgagttcaatctgccccctcccccgccgccgccgaaggccaagactgaggccgccgcagaggagaccaagacggaggcgccggccaaggaggaggccaagaccgaggagccggccaaggcggaagaaccagccaaggaggagcccaaggctgaagagccggccaaggccgaggcggcagcggcggagccagcagccgaggagcccaaggccgtggtcgctgccgaggcagcagccgaggagccggccaaggaggaacccaaggccgaggaggccaagccggccgagccaaagaaggaggaggaagcagtcgtggtcgccgaggagggcaccaagacggcggaaccggtcgaggaggccgccgccgccgccaccaccacagagcaggcagcggcgccggaaccggaggcggaggcagccgcgcccgagccggtgttcatctggggcgtgccgctggtgggcgacgacgagcgcacggacgcggtgctgctcaagttcctgcgcgcgcgggagttcaaggtgaaggaggcgatggcgatgctccggtccgccgtgctctggcggaagcgcttcggcatcgagtcgctcctggaggcggacctggccttcccggagctggagaaggtggtgttctaccgcggcgccgaccgggagggccaccccgtctgctacaacgtgtacggcgagttccaggacaaggaggtgtacgagaaggcgttcggcgacgaggagaagcgggagcggttcctcaagtggcgcatccagctgctggagcgcggcatcctgtcgcagctggacttcgcgcccagcggcatctgctccatggtgcaggtcaccgacctcaagaactcgccgcccatgctcggcaagcaccgcgccgtcacccgccaggccgtcgccctgctccaggacaactaccccgagttcatcgccaagaaggtgttcatcaacgtgccatggtggtatctcgctgccaacaaaatgatgagccctttcctcacccagcgcaccaagagcaagttcgtgttcgccagccaggccaagtcacccgagaccctcttcagatacatcgcgccggagcaagtccccgtccaattcggaggcctcttcaaggaagatgaccctgatttcaccacctccgactctgtcaccgagctcaccatcaaagcttcatccaaagaaaccattgagatccctgtcaccgagaactcaacgattgtatgggagctccgggtgctcggctgggaggtcagccacggcgcggagttcacccccgacgctgagggcgcgtacaccgtcatcgtgcagaagacaaggaaggtccccgcgaatgaggagcccatcatgaagggcagcttcaaggccggcgaggccggcaagatcgtgctcacggtcagcaacgccgcgtcgaagaagaagaagctcctctacagatccaaggtgaagtgcagcaccggcgagtccgttgaggccgacattccatgaccaccattggagtcagtccctgatgatgatagaagaagaagaagaagaagaagataaaccgcctttttggtttttgttctttgattccattggttttgtggtttttggttcgcattcccgcatttgtttaattattaaaattaaaaacccaaagtgagcttgattttgtgacggtacagtagttgggagaggaaggttggtatggatgggatgatataatggcatcgtgatggttgttgagggtagggcaagaggagaaaaatggatgatacaatctgctgctgctctgtaaatttgtctgtacattgttgcaatcgctggctggatcctcatggacatgttatatttagaagtacctgctgccatcaaaaaaac

SEQ ID NO: 18 - protein, 587 aa, Triticum aestivum
MAEEPQPQAAAAPAAAATEVVVAEKAPAEVEKKAEEPAAEAEAEETAAVADDGGAVEATGSFKEESNLVADLPDPEKKALDEFKELIVAALAAGEFNLPPPPPPPKAKTEAAAEETKTEAPAKEEAKTEEPAKAEEPAKEEPKAEEPAKAEAAAAEPAAEEPKAVVAAEAAAEEPAKEEPKAEEAKPAEPKKEEEAVVVAEEGTKTAEPVEEAAAAATTTEQAAAPEPEAEAAAPEPVFIWGVPLVGDDERTDAVLLKFLRAREFKVKEAMAMLRSAVLWRKRFGIESLLEADLAFPELEKVVFYRGADREGHPVCYNVYGEFQDKEVYEKAFGDEEKRERFLKWRIQLLERGILSQLDFAPSGICSMVQVTDLKNSPPMLGKHRAVTRQAVALLQDNYPEFIAKKVFINVPWWYLAANKMMSPFLTQRTKSKFVFASQAKSPETLFRYIAPEQVPVQFGGLFKEDDPDFTTSDSVTELTIKASSKETIEIPVTENSTIVWELRVLGWEVSHGAEFTPDAEGAYTVIVQKTRKVPANEEPIMKGSFKAGEAGKIVLTVSNAASKKKKLLYRSKVKCSTGESVEADIP

SEQ ID NO: 19 - DNA, 1393 bp, Triticum aestivum
ggtccggaatttccgggtcgacccacccgtccgggaggagcccaaggccgaggaggccatcgaggagaccgccgtccccgccgcggccgagccggaggcggcgcccgccgccgagcccaaggaggagctgatctggggcgtgccgctggtgggcggcgacgagcgcacggacacggtgctcctcaagttcctccgcgcgcgcgagttcaaggtgaaggaggccatggcgatgctcaaggcggcggtgctgtggcgcaagagcttcggcatcgacgcgctcctgggcgccgacctcggcgtgccggagctggagaacgtcgtcttctaccgcggcgccgaccgcgagggccaccccgtctgctacaacgtctacagcgagttccaggacaaggacctctacgagaaggccttcggcgacgacgagaagcgggagcgcttcctcaggtggcgcatccagctcctcgagcgcggcatccgggagcagctcgacttctcgcccagcggcatctgctccatggtgcaggtcaccgacctcaagaactcgccgcccatgctcggcaagcaccgcgccgtcacccgccaggcgctcgcgctgctccaggacaactaccctgaattcatcgccaagaaggtgttcatcaatgtgccatggtggtatcttgcggcaaacaagatgatgagcccattcctcacacagcgcaccaagagcaaattcacgttttgcagcccagccaagaccgcagagaccctattcagatacatcgcgccggagcaggtccctgtccaattcggcggcctctacaaagaggatgatactgaattctccacttctgatggcgtgaccgagctcactgtcaaaccttcttccaaagaaactgttgagattcctgctactgagaactccacggtcgtgtgggagctccgtgtgcttggatgggaggtgagctacggcgtggagttcaccccggacgccgagggcggctacacggtcatcgtgcagaagactcggaaggtgcccgccaacgaggagccaatcatgaagggtagcttcaaagcgagcgagcctggcaaggtggtgctcatcgtcaacaacccgacgtcgaagaagaagaagctgctgtgccgattcaaggtgaagagctccaccgaatcctccgcctgatgaggttccagctgctgatacaaccgccaaccaggtccataccaccgccaccatttgaacatgtcgcatgataggggagagcaaataagattttagtagatggccgttttcgtgtcgggttctttgatttgttggcttgctgttttttgggggtcggatttgtatgtgtgtttactcggaaccaaagtgggcttgttctatgaatgagataggtactcctggctgggatcc

SEQ ID NO: 20 - protein, 312 aa, Triticum aestivum
MAMLKAAVLWRKSFGIDALLGADLGVPELENVVFYRGADREGHPVCYNVYSEFQDKDLYEKAFGDDEKRERFLRWRIQLLERGIREQLDFSPSGICSMVQVTDLKNSPPMLGKHRAVTRQALALLQDNYPEFIAKKVFINVPWWYLAANKMMSPFLTQRTKSKFTFCSPAKTAETLFRYIAPEQVPVQFGGLYKEDDTEFSTSDGVTELTVKPSSKETVEIPATENSTVVWELRVLGWEVSYGVEFTPDAEGGYTVIVQKTRKVPANEEPIMKGSFKASEPGKVVLIVNNPTSKKKKLLCRFKVKSSTESSA

SEQ ID NO: 21 - DNA, 2018 bp, Glycine max
  misc_feature (1862)..(1862): n is a, c, g, or t
  misc_feature (1878)..(1878): n is a, c, g, or t
  misc_feature (1889)..(1889): n is a, c, g, or t
  misc_feature (1922)..(1922): n is a, c, g, or t
  misc_feature (1929)..(1930): n is a, c, g, or t
  misc_feature (1936)..(1936): n is a, c, g, or t
  misc_feature (1962)..(1962): n is a, c, g, or t
  misc_feature (1971)..(1972): n is a, c, g, or t
  misc_feature (2006)..(2006): n is a, c, g, or t
gaagcaactcttgtcttccctttcaacttcaactcaaccctcaatcaaactcattctgtcttttcttctatttttatttctatccaatcatccatggccgaggaaccccaaaaaccagcctccgctgaagaagtggtcgctgttcctgcggagaacccaccatctgaagccgaagctgaaaacatcgaagcagagaaggcccagagtggtgtagaagacaagatttcccagtcggtttcgttcaaggaggagaccaacgtggttggcgacctccccgaggcgcagaagaaagcccttgatgagctcaagaagcttgttcaagaagcgctcaacaaccatgagctaactgctcccaagccagaaccggagaagaagaaaccagcagcagagaagaaggaggaagttgaagtgacagaagggaagaaggaagctgaagtcatagaagagaagaaggaagtggaagtgacggaagagaagaaggaaattgaagtaacagaagagaagaaggaagctgaagtcatagaagagaagaaggaagtggaagtgacggaagagaagaaggaaattgaagtaacagaagagaagaaggaagcagaagtgaaagaagagaagaaggaaggggaagtgacggaagagaagaaggaagttgaagtgacggaagagaagaaggaagcggaagtgatagtagaagagaagaaggaagttgaagtgacggaagagaagaaggaagtggaagtgaccgaaggaaagaaagaagtggaagtgatcgaagagaagaaggaaacagaagtgacagaagaaaagaaagaagtggaagtagaagtgagggaagagaagaaggaaagtgaagtgaaagaagaagaaaaaggtcgggaggttgttccagaggaagttgagatatggggaattcccctgctgggggacgagaggagcgatgtgattctgctaaagtttcttagggcaagggatttcaaggtgaaggaggccttgaacatgataagaaacacggtgcgatggagaaaggaatttggaatagagggtctagtggaggaagatcttggaagtgattgggagaaggtggtgttcaaggatggatacgacaaagaagggcacccggtgtactacaacgtctttggggagtttgaggacaaggagttgtacagcaagacgtttttggacgaggaaaagaggaacaagttcataaggtggaggattcagtcgttggagaagagcgttagaagccttgacttctctccgaatgggatatcgacaatagttcaggtgaacgaccttaagaactctcccggactgggcaagagggaactgaggcaggccaccaatcaggcccttcaactgcttcaggacaactaccctgagttcgttgccaagcagatattcatcaatgtcccctggtggtaccttgccttttctaggatgatcagtcccttcttcacacagaggaccaagagtaaatttgtttttgctggcccttccaaatctgctgatacccttttcagatatatagctccggagctggtcccggttcaatacggtggtcttagcagagaggctgaacaggaattcacctctgcttaccctgttacggagtttactattaaacccgctaccaaacattctgttgagttccctgtttctgagaaaagccatcttgtttgggaaatccgagtggtgggttgggatgtcagctatggagctgaatttgtgcccagcgctgaggatggatacactgtcatagtacacaagagcaggaaaattgctcccgctgatgagaccgttcttaccaacggtttcagaattggtgaacctggcaagattgtactcaccatagacaaccaaacatncaagaagaagaaactnctctacaggtnccagaccaaacccattgcagagtaagcttgatnaggatgnntactgntactgtatattcatcattacaaccancacaacatnngtggttgggcgagggacttattctttcatacggngtcttcttttct

SEQ ID NO: 22 - protein, 606 aa, Glycine max
  UNSURE (590)..(590): Xaa can be any naturally occurring amino acid
  UNSURE (599)..(599): Xaa can be any naturally occurring amino acid
MAEEPQKPASAEEVVAVPAENPPSEAEAENIEAEKAQSGVEDKISQSVSFKEETNVVGDLPEAQKKALDELKKLVQEALNNHELTAPKPEPEKKKPAAEKKEEVEVTEGKKEAEVIEEKKEVEVTEEKKEIEVTEEKKEAEVIEEKKEVEVTEEKKEIEVTEEKKEAEVKEEKKEGEVTEEKKEVEVTEEKKEAEVIVEEKKEVEVTEEKKEVEVTEGKKEVEVIEEKKETEVTEEKKEVEVEVREEKKESEVKEEEKGREVVPEEVEIWGIPLLGDERSDVILLKFLRARDFKVKEALNMIRNTVRWRKEFGIEGLVEEDLGSDWEKVVFKDGYDKEGHPVYYNVFGEFEDKELYSKTFLDEEKRNKFIRWRIQSLEKSVRSLDFSPNGISTIVQVNDLKNSPGLGKRELRQATNQALQLLQDNYPEFVAKQIFINVPWWYLAFSRMISPFFTQRTKSKFVFAGPSKSADTLFRYIAPELVPVQYGGLSREAEQEFTSAYPVTEFTIKPATKHSVEFPVSEKSHLVWEIRVVGWDVSYGAEFVPSAEDGYTVIVHKSRKIAPADETVLTNGFRIGEPGKIVLTIDNQTXKKKKLLYRXQTKPIAE

SEQ ID NO: 23 - DNA, 1642 bp, Glycine max
gaaatgaaagctaaggaaaggaagggtaaaggagcgtaaaactggaggagtttgtgtcttgttttcttgtggcggggcataggattccgaataaatgcatgtttcaactttcctttttcttctctcagtctctctagctagctttcttctccactctctcaaatggcccaaaatgattccaaccctactccgcctccggaaccccatgtagcggcggaacccattactgaggatttggtccaagacaaagaagaagaggatgatagtagtaagattgttattccagtcccagagagcgagtccttgtcattgaaggaggatagcaatagggtttctgattccgagaaaaatgccattgatgagctgaagaagctcctgaaagaggaattagaggacgaggaggtttccatctggggcgtccctctctttaaggatgacaggactgacgtcattctcctcaagtttctcagagctcgtgagctcaaagtgaaggacgcccttgtcatgtttcaaaacactctccgatggaggaaggacttcaacatcgacgcccttctggatgaagatctgggcgaccacttggagaaggttgtcttcatgcacggacacggcagagagggccatcccgtctgttacaacgtctacggcgagttccagaacaaggacctctaccacaaggccttctcctctcaggataatcgaaacaagtttctccgatggcgtattcagttgttggagcgcagtattcggcacctcgacttcactccttcctccggcatcaacaccattttccaagtcaatgacctcaaaaactcccctggccctgctaaacgtgagcttcgccttgccaccaaacaagctttgcagttgcttcaggacaactatcccgaatttgttgccaaacaggtttttatcaacgtcccatggtggtatcttgctttctataccatgatcaatcccttcttgacttcgaggaccaaaagcaaatttgtctttgctggaccatccaagtcccccgatactcttttcaagtatatttctcctgagcaagtgcccgttcagtatggtggcctcagtgtagatttctgtgactgcaaccccgatttcactatgtctgatcctgtcaccgaaattcctataaagcctaccactaagcaaactgtggaaattgctatttatgagaagtgcattattgtttgggagctgcgcgtggtgggctgggaggttagctacaatgctgaattcaagcctgatgttgaagatgcatatacggttatcatacagaaggccacaaagatgtcccccaccgatgaaccagttgtttccaatagctttaaagttgttgaactgggaaaattgttgctcaccatagacaatcctaccttgaaaaaaaagaggcttctttacaggttcaagatcaaaccctactctgattgagagaaaataacctctggtggtggttttgggtacatgaaggaaattgaacttgaagagtaagaaatatgcatgtcatcatttgttcggtccatttttcatctatagttttggtcgtgagttgtttgcagattgtctttctctgtctttgttggttggtggggtgtttgaacactttattgctagtctaaattgttctttaattttc

SEQ ID NO: 24 - protein, 424 aa, Glycine max
MAQNDSNPTPPPEPHVAAEPITEDLVQDKEEEDDSSKIVIPVPESESLSLKEDSNRVSDSEKNAIDELKKLLKEELEDEEVSIWGVPLFKDDRTDVILLKFLRARELKVKDALVMFQNTLRWRKDFNIDALLDEDLGDHLEKVVFMHGHGREGHPVCYNVYGEFQNKDLYHKAFSSQDNRNKFLRWRIQLLERSIRHLDFTPSSGINTIFQVNDLKNSPGPAKRELRLATKQALQLLQDNYPEFVAKQVFINVPWWYLAFYTMINPFLTSRTKSKFVFAGPSKSPDTLFKYISPEQVPVQYGGLSVDFCDCNPDFTMSDPVTEIPIKPTTKQTVEIAIYEKCIIVWELRVVGWEVSYNAEFKPDVEDAYTVIIQKATKMSPTDEPVVSNSFKVVELGKLLLTIDNPTLKKKRLLYRFKIKPYSD

SEQ ID NO: 25 - DNA, 2353 bp, Zea mays
tccgccccgccctgtcgctttcccttccacacgcgccgttcgctttgatcgaccaggcaggcatggccgacgagacgaagcaagaagccgccgccccggcggccgaggtggtcgtgacggaggaggagaagaaggcagaagagaccgccccggtggcggaggaaaaggccgtggaggcggctgtagagaaggccgcggaggcggaggcgggggccgaggaaaaggccgcggaagcggactcggaggaggagaagaaggcggaggaggccgaggaggccgccgcgggcgatgaggcggccgtgatcgatggcactgggtcgttcaaggaggagagtaacctggtgtccgagctccccgaccctgagcgcacagcgctcgcgcagctcaaggagctcgtcgccaccgcgctcgctaacggggagttcaacctgccgccgccgcctgccaaggaggaggccaagaaggaggagccggcaaaggaagaagctccggcggacaaggaggacgagcccaaggcagaggaggcggctgcccaagagcccgtcaaggaggaggccaagcctgaggagcccaaaacggaggcgccggcggaagcagcgcccgaggaggttaaggacgagacacccgtgccggaagagaccaagactgaggctcccgcgccggaggagcccaaggccgaggagcctgccaaggaggagctcaaggcagaggcggcgacggaagcggtcgccgaggagaccaaaccagctgagccggtgccggaggaggaggagaagacggtcgttgttgccgaggaggaggccaccaaaacggtggaagccatcgaggagacggtcgccgtcgccgtcgccgccgccgcgtccgaggagcccgaggcgggcgagccgaaggaggagctgatctggggcgtgccgctggcgggcgacgacgagcgcacggacacggtgctgctcaagttcctccgcgcgcgcgagttcaaggtgaaggaggcgatggcgatgctcaagtcggcggtgctgtggcgcaagcggttcggcatcgacgagctcctcctggacgccgacctcggcctgcgggagctggagggcgtggtgttctaccgcggcgccgaccgcgagggccacccggtctgctacaacgtgtacggcgagttccaggacaaggagctgtacgagagggccttcggcgacgaggagaagcgggagcgcttcctcaagtggcgcatccagctcctggagcgcggcatccgggagcagctcgacttctcgcccagcggcatctgctccatggtgcaggtcaccgacctcaagaactcgccgcccatgctcggcaagcaccgcgccgtcacgcgccaggctctcgccctgctacaggacaactacccggagttcgtggccaagaaggtgttcatcaacgtgccgtggtggtacctggcggcaaacaaggtgatgagcccattcctgactcagcgcaccaagagcaagatcgtcttctgcagccctggcaagtcggcggagaccctcttcagatacatcgccccggagcaagtccccgtccagttcggcggcctgtacaaggaggacgacacggagttctccacctccgacgccgtcaccgagctcaccgtgaaaccgtcctccaaggagaccgtcgagatcccagccaccgagaactccaccgtggtgtgggagctccgcgtgctggggtgggaggtgagctacggcgccgagttcacccccgacgcggagggcggctacaccgtcatcgtgcagaagacgcggaaggtccccgcccacgaggagcccatcatgaagggcagcttcaaggccacggagcccggcaagctggtgctgggcgtgaacaacccggcgtccaggaagaagaagctgctgtgccggttcaaggtgaggagcgccgccgcctgatgagggtcgttggtctgggtcccagcaggtacagcctgccagctgcttgaccaccagcccgacatgtataattcgatcgatcgccaaccaggtccataccgccaccatttgaatgaacatgctgcattgcattacatgataggagagagagagagagagagagaggacaataaagagtttctgcttcctagctaggcccgttccgtgtcctggtcgttctttgattatttgttggcttgctgttcttttttttccttggggggagggtcgcgtttgtatgtgtttattacttgaatgaaaacaaaagtgagcttgttaatgaaaaaaaaaaaaaaaaatgttgaggtcaccgtggtccgtggtggggtgggggaagaagaacagtaacagttgctgcccggcctgtacatttctttcaaaaaaaaaaa

SEQ ID NO: 26 - protein, 620 aa, Zea mays
MADETKQEAAAPAAEVVVTEEEKKAEETAPVAEEKAVEAAVEKAAEAEAGAEEKAAEADSEEEKKAEEAEEAAAGDEAAVIDGTGSFKEESNLVSELPDPERTALAQLKELVATALANGEFNLPPPPAKEEAKKEEPAKEEAPADKEDEPKAEEAAAQEPVKEEAKPEEPKTEAPAEAAPEEVKDETPVPEETKTEAPAPEEPKAEEPAKEELKAEAATEAVAEETKPAEPVPEEEEKTVVVAEEEATKTVEAIEETVAVAVAAAASEEPEAGEPKEELIWGVPLAGDDERTDTVLLKFLRAREFKVKEAMAMLKSAVLWRKRFGIDELLLDADLGLRELEGVVFYRGADREGHPVCYNVYGEFQDKELYERAFGDEEKRERFLKWRIQLLERGIREQLDFSPSGICSMVQVTDLKNSPPMLGKHRAVTRQALALLQDNYPEFVAKKVFINVPWWYLAANKVMSPFLTQRTKSKIVFCSPGKSAETLFRYIAPEQVPVQFGGLYKEDDTEFSTSDAVTELTVKPSSKETVEIPATENSTVVWELRVLGWEVSYGAEFTPDAEGGYTVIVQKTRKVPAHEEPIMKGSFKATEPGKLVLGVNNPASRKKKLLCRFKVRSAAA

SEQ ID NO: 27 - DNA, 2151 bp, Zea mays
caacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgtggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgccgccctcgccgccggtgagttcaacctgcctcccccgccgccgccgccgaaggccaaggagacgaaggtggaggaagccaaggccgaggagcccgccaaagaagagcccgcggccgaggcggaggctacggcggaggagcccaaggcccaggtggctgcggatgccccggttgaggaggtcaagacggaggtgccgccggccgaggaggccaaggctgagacactggctgaggaagccaagccttccgagcccgagccgcaggagaagaccgtcgtggtcactgaggaggagactgccaccaagacggtggaagcaatcgaggaaaccgtcgtgtccgcccccgccgccatcccggaggaagcagcggcgccagaggcggtggtcgaggctcaggcgaccgcgcctgaacccgtgctgatttggggcgtgccgctggtcggcgacgacgagcgcacggacacggttctgctcaagttcctgcgtgcgcgggagttcaaggtgaaggatgccatggcgatgctcaagtccgcggtgctgtggcgcaagcgcttcggcatcacctcgctcctcgacgccgacctcggcctgacggagctggagaacgtggtgttctaccgcggcacggaccgcgaaggccaccccgtgtgctacaacgtctacggtgagttccaggacaaggatctctacgagaaggccttcggcgacgatgagaagagggagcgcttcctcaagtggcgcatccagctgctggagcgcggcattctgtcgaagctggacttctcgcccagcggcatctgctccatggttcaggttaccgacctcaagaactcgccgcctatgctcggcaagcaccgcgccgtcacccgccaggctgtcacgctgctccaggacaactaccccgagttcattgccaagaaggtgttcatcaatgtgccgtggtggtatctagccgccaacaagatgatgagcccgttcctcacacagcgcaccaagagcaagttcgtctttgctagcccagccaaatcagcagcgactctattcagatacatcgcaccggaacaagttcctgtccaatttggaggcctcttcaaggaggatgatcctgagttcaccacctctgacactgtctccgagctcactatcaaaccatcctcaaaagaaaccgttgagatccctgtcaccgagaactccacaattgtatgggaactccgggtgctgagttgggaagtgagctatggcgccgagttcacccccgacgcggagggtgggtacaccgtcattgtacagaagacaaggaaggtgcctgctaacgaggaaccgatcatgaagggaagcttcaaggcaggcgagcctggcaaacttgtgctaactgtgaacaaccctgcatccaagaagaagacgctcctttacagatcgaaggtgaagagcaccagcgagtgagtgtgaggtcacgccgctagctgcctgggccctacagttaaaacgatctacagcatgatagaagagagaaggaaccttttggtttggttcgttaatttactgggttttttttttgggttcgcattctacattttgtttggttgaaaccaaagtgagcttgtttttgtgacagtagatgggagaagtataatggcattgtgtgatggatggttgttgatgagggcagggaggacgaaaatgtgggggaatgaaaggttggagaatgtctgttcctctgtagatgtgttctgtacattgcatctcttggattctcattgatatgttaaaatttaggagtacttggtcacatcattattcaatccatgttactctgc

SEQ ID NO: 28 - protein, 571 aa, Zea mays
MAEETQPEAAAAAAPAAAEVVVTEAAPAEAEVPVAAEAEAEAKDEKKGDEAELTADDAGVGTGSFKEESNLVEDLPDPEKKALDEFKQLIAAALAAGEFNLPPPPPPPKAKETKVEEAKAEEPAKEEPAAEAEATAEEPKAQVAADAPVEEVKTEVPPAEEAKAETLAEEAKPSEPEPQEKTVVVTEEETATKTVEAIEETVVSAPAAIPEEAAAPEAVVEAQATAPEPVLIWGVPLVGDDERTDTVLLKFLRAREFKVKDAMAMLKSAVLWRKRFGITSLLDADLGLTELENVVFYRGTDREGHPVCYNVYGEFQDKDLYEKAFGDDEKRERFLKWRIQLLERGILSKLDFSPSGICSMVQVTDLKNSPPMLGKHRAVTRQAVTLLQDNYPEFIAKKVFINVPWWYLAANKMMSPFLTQRTKSKFVFASPAKSAATLFRYIAPEQVPVQFGGLFKEDDPEFTTSDTVSELTIKPSSKETVEIPVTENSTIVWELRVLSWEVSYGAEFTPDAEGGYTVIVQKTRKVPANEEPIMKGSFKAGEPGKLVLTVNNPASKKKTLLYRSKVKSTSE

SEQ ID NO: 29 - DNA, 682 bp, Saccharum officinarum
  misc_feature (674)..(674): n is a, c, g, or t
cggacgcgtgggcaaaacggtggaagccatcgaggagaccgctgtcgcctccgccgtggccgaacctgaggcggaggccgcgccggcgccggcggccgagccgaaggaggagctgatctggggcgtgccgctggtgggcgacgacgagcgcacggacacggtgctgctcaagttcctccgcgcgcgcgagttcaaggtgaaggaggccctggcgatgctcaagtcggcggtgctgtggcgcaagcgcttcggcatcgacgagctcctgggcgccgacctcggcctgccggagctggagaacgtggtgttctaccgcggcgccgaccgcgagggccaccccgtctgctacaacgtctacggcgagttccaggacaaggagctctacgagaaggccttcggcgacgaggagaagcgggagcgcttcctcaagtggcgcatccagctcctcgagcgcggcatcagggagcagctcgacttctcgcccagtggcatctgctccatggtgcaggtcaccgacctcaagaactcgccgcccatgctcggcaagcaccgcgccgtcacacgccaggctctcgccctgctccaggacaactaccccgagttcgtggcccaagaggtgtttatcaatgtgccatggtggtacctcgcggcgaaacaagtgatgagcccattcnctgactca

SEQ ID NO: 30 - protein, 156 aa, Saccharum officinarum
  UNSURE (154)..(154): Xaa can be any naturally occurring amino acid
MLKSAVLWRKRFGIDELLGADLGLPELENVVFYRGADREGHPVCYNVYGEFQDKELYEKAFGDEEKRERFLKWRIQLLERGIREQLDFSPSGICSMVQVTDLKNSPPMLGKHRAVTRQALALLQDNYPEFVAQEVFINVPWWYLAAKQVMSPFXDS

SEQ ID NO: 31 - DNA, 837 bp, Saccharum officinarum
  misc_feature (563)..(563): n is a, c, g, or t
  misc_feature (588)..(588): n is a, c, g, or t
  misc_feature (755)..(755): n is a, c, g, or t
  misc_feature (760)..(761): n is a, c, g, or t
  misc_feature (771)..(773): n is a, c, g, or t
  misc_feature (807)..(807): n is a, c, g, or t
cctggagcagcgtgacaggacaactaccccgagttcattgccaagaaggtgttcatcaatgtgccgtggtggtatctcgctgccaacaagatgatgagcccgttcctcacacagcgcaccaagagcaagttcgtttttgctagcccagccaagtcagcagagactctattcagatacatcgcagcggagcaagttcctgtccaatttggaggcctcttcaaggaggacgaccctgagttcaccacctccgacactgtcgctgagctcactatcaaaccatcgtcaaaagaaaccattgagatccctgtcacggagaactccacaattgtatgggaactccgggtgctcggttgggaggtgagctatggtgctgagttcacccctgacgctgagggtgggtacactgtcattgtacagaaaacaaggaaggtgcccgctaacgaggaaccgatcatgaagggaagcttcaaggtacgcgagcccggcaaacttgtgctaactgtgaacaactcggcatccaagaagaagaagctccttcacagatcaaaggtgaagagcaccancgagtgagtgtgaggttgctgctanctgcctgggtcctacagttaaacgatctaccacagttaatctcagcatgatagaagagaggaaaaaccttttggtttggttcgttaatttattgggttttgcttgttttggtgcacattctacattttgtttggttaaacaaaagtgagcttgtttttggttgattnaaatnnatttccactnnnaaaaaaaaaaaaaataaatttaagggggggccgntttaaaaagggggggccgttcctataggaa

SEQ ID NO: 32 - protein, 159 aa, Saccharum officinarum
  UNSURE (158)..(158): Xaa can be any naturally occurring amino acid
  UNSURE (158)..(158)
MMSPFLTQRTKSKFVFASPAKSAETLFRYIAAEQVPVQFGGLFKEDDPEFTTSDTVAELTIKPSSKETIEIPVTENSTIVWELRVLGWEVSYGAEFTPDAEGGYTVIVQKTRKVPANEEPIMKGSFKVREPGKLVLTVNNSASKKKKLLHRSKVKSTXE

SEQ ID NO: 33 - DNA, 1143 bp, Saccharum officinarum
  misc_feature (1033)..(1033): n is a, c, g, or t
gcctgagcccgtgctgatctggggcgtgccgctggtgggcgacgacgagcgcacggacacggttctgcttaagttcctgcgagcgcgggagttcaaggtgaaggaggccattgcgatgctcaagtccgcggtgctgtggcgcaagcgcttcggcatcacctcgctcctcgacgccgacctcggcctgccggagctggagaacgtggtgttctaccgcggcgccgaccgcgagggccaccccgtgtgctacaacgtctacggcgagttccaggacaaggatctctacgagaaggccttcggcgacgatgagaagcgggagcgcttcctcaagtggcgcatccagctgctggagcgcggcatcctgtcgaagctggacttttcgcccagcggcatctgctccatggtccaggttaccgacctcaagaactcgccgcccatgctcggcaagcaccgcaccgtcacccgccaggctgtcacgctgctccaggacaactaccccgagttcattgccaagaaggtgttcattcaatgtgccgtggtggtatctcgctgccaacaagatgatgagcccgttcctcacacagcgcaccaagagcaagttcgtttttgctagcccagccaagtcagcagagactctattcagatacatcgcagcggagcaagttcctgtccaatttggaggcctcttcaaggaggacgaccctgagttcaccacctccgacactgtcgctgagctcactatcaaaccatcgtcaaaagaaaccattgagatccctgtcacggagaactccacaattgtatgggaactccgggtgctcggttgggaggtgagctatggtgctgagttcacccctgacgctgagggtgggtacactgtcattgtacagaatacaaggaaggtgcccgctaacgaggaaccgatcatgaagggaagcttcaaggtaggcgagcccggcaaacttgtgctaactgtgaacaagctagcatccaataagaagaagctccttcacagatcaaaggtgaagagcaccancgagtgagtgtgaagttgctgctagctggctgggtcctacagttcaacgatctaccacagtttatctcagcatgatagaagaaaggaaaaaccttttggcttgggtccgt

SEQ ID NO: 34 - protein, 244 aa, Saccharum officinarum
  UNSURE (243)..(243): Xaa can be any naturally occurring amino acid
MRSGSASSSGASSCWSAASCRSWTFRPAASAPWSRLPTSRTRRPCSASTAPSPARLSRCSRTTTPSSLPRRCSFNVPWWYLAANKMMSPFLTQRTKSKFVFASPAKSAETLFRYIAAEQVPVQFGGLFKEDDPEFTTSDTVAELTIKPSSKETIEIPVTENSTIVWELRVLGWEVSYGAEFTPDAEGGYTVIVQNTRKVPANEEPIMKGSFKVGEPGKLVLTVNKLASNKKKLLHRSKVKSTXE

SEQ ID NO: 35 - DNA, 1404 bp, Saccharum officinarum
  misc_feature (565)..(565): n is a, c, g, or t
  misc_feature (577)..(577): n is a, c, g, or t
ctctctcttgctcctctcctcgccaccgccgccgtgaaatccgcacgcgtgctgcgtcctgccgagttgtgagctgtgattgtgagtgagcgccatggccgtggaggctgtgtctggaaatggcgccgaggcggtggcgccggcgccggcgaaggaggtgaacgccaaggaggcggttgcggtgtccaagaacgcgtcgttcagggaggagagcaacttcctggacgatctcaaggagagcgagcgtaaggcgctcgccgagctccgcgacaaggtcgaggcggccatcgtggagggcaagctgttcgacgacggcggcaagccggaggcgaaggagaaggagcaggccaagaagaaggctgagaagaccgtggagaagaaagaggaggagcccgaagccgaagagaagggagaggaggacggcaagaaggaggccgacgccgaggaggagaaaaaggaaggcgaggaggaaggggagaagaaggacgacgaggagggtggaggagaagacaccaaggacgaggccaagaaagatgaagccggcgagaaggcggcggcgaaggangagaaagaggangagaagccggcggagacggcggccgtcgtcgtcgtcgacaaggacatcgcgctgtggggcgtgcctctgctcccgagcaagggagacgaggccacggacgtggtgctcctcaagttcctccgcgcgcgcgacttcaaggccggcgccgcgttcgagatgctccgccgcacgctccgctggcgcaggggctggaccggcttcagcgttgacgccgacgacgacgacgccgacctccccgaggagctcgcgggcgcgtgctacctcgacggcgcggaccgggagggccacccggtgtgctacaacgcgccgggcgtgttcgcggacgacgccgtgtacaagaaggcgctgggcaccgaggaaggcaaggccaggttcctccggtggcgggtccgcgccatggagcgccacgtggccgagctggacctgaggcccggcggcgccgcgtcgctgctgcaggtgaccgacctgaagaactcgccgggcccggccaagaaggacctccgcgtcgccgtcaagcaggtgctcgacctgttccaggacaactaccccgagctcgtcgcaagaaacatcttaatcaacgtgccgttctggtactacgcgttcagcgccctgttctacccgttcctgacgcagaggaccaagagcaagttcgtcgttgctcgcccgtccaaggtcaccgagaccctcctcaagtacattccgattgaggccatccccgtgaagtacggcggcctgaaacgcgacggcgacaccgagttcttcgcggacgacagcgaagtcacagaaggcaccgtcaaggaaagctccacgcagaccatcgagatcga

SEQ ID NO: 36 - protein, 436 aa, Saccharum officinarum
  UNSURE (157)..(157): Xaa can be any naturally occurring amino acid
  UNSURE (161)..(161): Xaa can be any naturally occurring amino acid
MAVEAVSGNGAEAVAPAPAKEVNAKEAVAVSKNASFREESNFLDDLKESERKALAELRDKVEAAIVEGKLFDDGGKPEAKEKEQAKKKAEKTVEKKEEEPEAEEKGEEDGKKEADAEEEKKEGEEEGEKKDDEEGGGEDTKDEAKKDEAGEKAAAKXEKEXEKPAETAAVVVVDKDIALWGVPLLPSKGDEATDVVLLKFLRARDFKAGAAFEMLRRTLRWRRGWTGFSVDADDDDADLPEELAGACYLDGADREGHPVCYNAPGVFADDAVYKKALGTEEGKARFLRWRVRAMERHVAELDLRPGGAASLLQVTDLKNSPGPAKKDLRVAVKQVLDLFQDNYPELVARNILINVPFWYYAFSALFYPFLTQRTKSKFVVARPSKVTETLLKYIPIEAIPVKYGGLKRDGDTEFFADDSEVTEGTVKESSTQTIEI

SEQ ID NO: 37 - DNA, 1658 bp, Triticum aestivum
ccacgcgtccgctctccccctctccctcctgctctatctttctcaccgcaaaagcttgaaacaccccgcggagatggcagaggagccgcagccacaggccgccgccgcccccgccgccgcggccacggaggtggtcgtcgccgagaaggcgccggcggaggtggagaagaaggccgaggagcccgcggcggaggcggaggccgaggagacggccgccgttgccgacgacgggggcgccgtcgaggccaccggctctttcaaggaggagagcaacctcgtcgccgacctgcctgacccggagaagaaggcgctcgacgagttcaaggagctgatcgtcgccgcgctcgccgccggtgagttcaatctgccccctcccccgccgccgccgaaggccaagactgaggccgccgcagaggagaccaagacggaggcgccggccaaggaggaggccaagaccgaggagccggccaaggcggaagaaccagccaaggaggagcccaaggctgaagagccggccaaggccgaggcggcagcggcggagccagcagccgaggagcccaaggccgtggtcgctgccgaggcagcagccgaggagccggccaaggaggaacccaaggccgaggaggccaagccggccgagccaaagaaggaggaggaagcagtcgtggtcgccgaggagggcaccaagacggcggaaccggtcgaggaggccgccgccgccgccaccaccacagagcaggcagcggcgccggaaccggaggcggaggcagccgcgcccgagccggtgttcatctggggcgtgccgctggtgggcgacgacgagcgcacggacgcggtgctgctcaagttcctgcgcgcgcgggagttcaaggtgaaggaggcgatggcgatgctccggtccgccgtgctgtggcggaagcgcttcggcatcgagtcgctcctggaggccgacctggccttcccggagctggagaaggtggtgttctaccgcggcgccgaccgggagggccacccggtgtgctacaacgtgtacggcgagttccaggacaaggaggtgtacgagaaggcgttcggcgacgaggagaagcgggagcggttcctcaagtggcgcatccagctgctggagcgcggcatcctgtcgcagctggacttcgcgcccagcggcatctgctccatggtgcaggtcaccgacctcaagaactcgccgcccatgctcggcaagcaccgcgccgtcacccgccaggccgtcgccctgctccaggacaactaccccgagttcatcgccaagaaggtgttcatcaacgtgccatggtggtatctcgctgccaacaaaatgatgagccctttcctcacccagcgcaccaagagcaagttcgtgttcgccagccaggccaagtcacccgagaccctcttcagatacattgcgccggagcaagttcccgtccaatttggaggcctcttcaaggaagatgaccctgatttcaccacctccgactctgtcaccgagctcaccatcaaagcttcatccaaagaaaccattgagatccctgtcaccgagaactcaacgattgtatgggagctccgggtgctcggctgggaggtcagccacggcgcggagttcaccccggacgccgagggggcgtacaccgtcatcgtgc

SEQ ID NO: 38 - protein, 528 aa, Triticum aestivum
MAEEPQPQAAAAPAAAATEVVVAEKAPAEVEKKAEEPAAEAEAEETAAVADDGGAVEATGSFKEESNLVADLPDPEKKALDEFKELIVAALAAGEFNLPPPPPPPKAKTEAAAEETKTEAPAKEEAKTEEPAKAEEPAKEEPKAEEPAKAEAAAAEPAAEEPKAVVAAEAAAEEPAKEEPKAEEAKPAEPKKEEEAVVVAEEGTKTAEPVEEAAAAATTTEQAAAPEPEAEAAAPEPVFIWGVPLVGDDERTDAVLLKFLRAREFKVKEAMAMLRSAVLWRKRFGIESLLEADLAFPELEKVVFYRGADREGHPVCYNVYGEFQDKEVYEKAFGDEEKRERFLKWRIQLLERGILSQLDFAPSGICSMVQVTDLKNSPPMLGKHRAVTRQAVALLQDNYPEFIAKKVFINVPWWYLAANKMMSPFLTQRTKSKFVFASQAKSPETLFRYIAPEQVPVQFGGLFKEDDPDFTTSDSVTELTIKASSKETIEIPVTENSTIVWELRVLGWEVSHGAEFTPDAEGAYTVIV

SEQ ID NO: 39 - DNA, 1722 bp, Arabdidopsis thaliana
atggctcaagaggaagtacagaaatcggctgatgtcgctgctgctccggtggtgaaggagaaacctattaccgataaggaggttactattcctacccctgtggcagagaaagaggaagttgctgctcctgtctctgatgagaaggcggttccagagaaggaggtgactccggagaaggaagccccagcggcggaagcggagaaatctgtttcggtgaaggaggaagagacggttgttgtagctgagaaggttgttgttttaactgctgaggaagttcagaagaaggcacttgaggagtttaaggagcttgtaagggaggctttgaacaaacgtgaattcactgctccggtgacgccggttaaggaagagaaaacagaggagaagaaaacagaggaggaaactaaagaggaagagaaaacagaggagaagaaagaagagacaacgactgaggttaaggttgaagaagagaaaccggcggttccagcggcggaggaggagaaatcatcagaggctgctccggttgagaccaaatctgaggagaaacctgaagagaaagcagaggtaacaaccgagaaagcatccagtgccgaagaagatggaaccaagaccgtggaagcaatcgaagaatctatcgtctctgtttcaccacctgaatccgccgtagcacctgtcgtggtagagactgtcgccgttgctgaggcagagccagtggagccggaagaagtctcgatctggggagttccactactccaagacgagagatctgacgtgatcctcacgaaattcctccgtgcaagagactttaaggtcaaagaagctttaaccatgcttaaaaacaccgtccagtggcgtaaagaaaacaaaatcgacgaactcgttgaatccggagaagaagtgagtgagttcgagaagatggtgtttgctcacggtgttgacaaagaaggacacgtcgtgatctacagttcttacggtgagtttcagaacaaggagcttttctccgacaaggagaagcttaacaagttcctcagctggaggattcagctacaagagaagtgtgtgagagctattgatttcagcaaccctgaagcgaagtcttcgtttgtgttcgtcagcgacttcaggaacgctccaggacttggtaaaagagccttgtggcaattcatcagacgcgctgttaaacaattcgaggacaattatcctgaattcgccgctaaagagctattcatcaatgtcccatggtggtacattccatactacaaaacattcggatctatcatcacatccccaaggactaggagcaagatggtccttgctggtccatccaaatctgccgatactattttcaaatacatagctcctgaacaagttcccgttaaatacggtggacttagcaaagatactcctttgaccgaagaaaccataacggaagccatcgttaaaccggcagcaaactacactattgaattgcctgcttctgaggcttgcacgctttcatgggagcttagggttttgggtgctgatgtgagctacggagctcagtttgagccaaccaccgaaggaagctatgctgtgatcgtctctaagacacggaagattggatcaaccgatgaaccggtgataaccgattcttttaaggtgggtgaaccgggaaagattgtgatcacaatcgacaaccagacttccaagaagaagaaagtgctctacaggttcaaaactcaataa

SEQ ID NO: 40 - protein, 573 aa, Arabdidopsis thaliana
MAQEEVQKSADVAAAPVVKEKPITDKEVTIPTPVAEKEEVAAPVSDEKAVPEKEVTPEKEAPAAEAEKSVSVKEEETVVVAEKVVVLTAEEVQKKALEEFKELVREALNKREFTAPVTPVKEEKTEEKKTEEETKEEEKTEEKKEETTTEVKVEEEKPAVPAAEEEKSSEAAPVETKSEEKPEEKAEVTTEKASSAEEDGTKTVEAIEESIVSVSPPESAVAPVVVETVAVAEAEPVEPEEVSIWGVPLLQDERSDVILTKFLRARDFKVKEALTMLKNTVQWRKENKIDELVESGEEVSEFEKMVFAHGVDKEGHVVIYSSYGEFQNKELFSDKEKLNKFLSWRIQLQEKCVRAIDFSNPEAKSSFVFVSDFRNAPGLGKRALWQFIRRAVKQFEDNYPEFAAKELFINVPWWYIPYYKTFGSIITSPRTRSKMVLAGPSKSADTIFKYIAPEQVPVKYGGLSKDTPLTEETITEAIVKPAANYTIELPASEACTLSWELRVLGADVSYGAQFEPTTEGSYAVIVSKTRKIGSTDEPVITDSFKVGEPGKIVITIDNQTSKKKKVLYRFKTQ

SEQ ID NO: 41 - DNA, 1473 bp, Arabdidopsis thaliana
atggctgaagaacctactactaccactctcgttacaccggaaaagctaccttctccgagcctcacgccttctgaagtatctgaatctactcaagatgccctaccgacagagacagaaactctggagaaagtgactgagactaatccaccggaaactgcagataccaccaccaagccagaagaagaaaccgcggcagagcatcatccaccgacagtgacggaaacagaaactgcatcgacggagaaacaagaggttaaagacgaagcatcgcagaaagaagtagctgaagagaaaaagagtatgattccacagaatcttggttcattcaaagaagaaagcagcaaactttctgatctatctaattccgagaagaaatcactcgatgaactaaaacatctagttcgagaagctctagacaatcaccaattcaccaacacaccagaagaagtcaagatttgggggattccattacttgaagacgatagaagcgacgtcgttttgttaaaattcctaagagctagggagttcaaggtgaaagattcgtttgctatgctcaagaacacaatcaagtggagaaaggagttcaagatcgatgaattggtcgaggaagatcttgtggatgatcttgacaaggttgtgtttatgcatggacatgaccgagaaggtcaccctgtttgttacaatgtctatggtgagtttcagaacaaggagctttataataagacgttttctgatgaggaaaagaggaaacatttcttgaggactaggattcagttcttggagaggagtataaggaagctagattttagctctggtggggtttctactatttttcaggttaatgatatgaagaattctccggggttagggaagaaagagcttagatcagctactaagcaagctgttgagttgcttcaggacaattaccctgagtttgtcttcaaacaggcttttatcaatgttccttggtggtaccttgtgttttatactgtgattggtccgttcatgacaccaagatcaaagagcaagcttgtgtttgctggtccttcgcgttcagctgaaaccctattcaaatacatatcacccgagcaagttccagtacaatatggtggattgagtgttgatccttgcgactgcaatccagacttttcgttggaagattcagcctctgagatcactgttaagcccggaacaaaacaaactgttgagatcataatctatgagaaatgtgaacttgtgtgggagataagggtaactggatgggaagtgagctacaaggctgaatttgtgccggaagagaaagatgcttacacggtggttatacaaaaaccgaggaagatgagaccatccgatgaaccggtgttaacccatagcttcaaagtgaatgagcttggcaaggttttactcacagtagacaacccaacctctaagaagaagaagctcgtttacaggttcaatgtcaaacctctctaa

SEQ ID NO: 42 - protein, 490 aa, Arabdidopsis thaliana
MAEEPTTTTLVTPEKLPSPSLTPSEVSESTQDALPTETETLEKVTETNPPETADTTTKPEEETAAEHHPPTVTETETASTEKQEVKDEASQKEVAEEKKSMIPQNLGSFKEESSKLSDLSNSEKKSLDELKHLVREALDNHQFTNTPEEVKIWGIPLLEDDRSDVVLLKFLRAREFKVKDSFAMLKNTIKWRKEFKIDELVEEDLVDDLDKVVFMHGHDREGHPVCYNVYGEFQNKELYNKTFSDEEKRKHFLRTRIQFLERSIRKLDFSSGGVSTIFQVNDMKNSPGLGKKELRSATKQAVELLQDNYPEFVFKQAFINVPWWYLVFYTVIGPFMTPRSKSKLVFAGPSRSAETLFKYISPEQVPVQYGGLSVDPCDCNPDFSLEDSASEITVKPGTKQTVEIIIYEKCELVWEIRVTGWEVSYKAEFVPEEKDAYTVVIQKPRKMRPSDEPVLTHSFKVNELGKVLLTVDNPTSKKKKLVYRFNVKPL

SEQ ID NO: 43 - DNA, 2052 bp, Arabdidopsis thaliana
atggctcaagaagagatacagaaacctactgcctctgttccagtggttaaggaggaaactcctgccccggttaaggaggttgaggtgccggttactacggagaaagctgtggctgcgcctgctccggaagctacggaggagaaagttgtgtctgaggtggcggtgcctgaaacagaggtgacggcggtgaaagaggaggaggttgcgacgggaaaggagatcttgcaatcggagtcgtttaaggaggaaggctatttggcttctgaattacaggaagctgagaagaatgctttggctgagttaaaggagttggttagggaggctttgaacaagcgtgaattcaccgcgccaccgccaccaccagctccggtaaaggaagagaaagttgaggagaagaaaacagaggaaacagaggaaaagaaggaagaagttaaaacagaggaaaaatctcttgaggctgaaaccaaagaagaggagaaatctgctgctccggccaccgtagagaccaagaaagaagagatcttggccgctccggctccgatcgtcgcagagaccaagaaggaagagacaccagttgctcctgctccggtagagactaaaccggctgctccggtcgttgcagagacaaagaaggaagaaatattaccagctgctccggtcaccacagagaccaaggtggaagagaaagtcgttccagtagaaaccacaccggctgctccagtcaccacagagaccaaggaagaagagaaagccgctccggtcaccacagagaccaaggaggaagagaaagcagctccgggagagaccaagaaagaagagaaagcaaccgcctctactcaggtcaagagggcctcaaaatttattaaagatatatttgtctcagtcaccactagcgagaagaagaaggaagaagagaaaccagcagtagtaacaatcgagaaggctttcgcagctgatcaagaagaagaaacaaaaaccgttgaagcagtcgaagaatcaatcgtctccatcactcttccagagacagctgcatacgtagagccagaagaagtctcaatctggggaatcccacttctagaggacgaaagatccgacgtgatcctcctcaaattcctccgtgcacgtgacttcaaggtcaaagaagccttcacgatgctgaaaaacaccgtccaatggcgcaaagagaacaagatcgacgacctagtctcagaagatcttgaaggaagcgagtttgagaagttggtgttcactcacggtgtcgacaaacaaggacatgtcgtgatctatagctcgtacggtgagtttcagaacaaggagattttctcagataaagagaagcttagcaagtttctcaaatggaggattcagttccaagagaagtgtgtgaggtctcttgactttagccctgaggctaagtcatcgttcgtgttcgttagtgacttcaggaacgctcctggacttggtcagagagcattgtggcagttcattaaacgcgccgttaagcaattcgaagataactatccagagtttgtcgctaaagagctgttcattaatgtcccatggtggtacattccttactacaaaacattcggaagtatcattacatcgccaaggacaaggagcaagatggtcctttctggtccatccaaatccgctgagaccattttcaaatacgtagctcctgaagtagtcccggttaagtatggtggactcagcaaagatagtccattcaccgttgaagatggagtcaccgaggccgtagttaaatcgacatctaaatataccattgatttgcctgctacagagggttccacgctctcatgggagcttagggttttgggtgcggacgtgagctacggagctcaatttgagccaagcaatgaggcaagctacaccgtgattgtctctaagaaccggaaggtcggtttaactgatgaaccggtgataaccgattctttcaaggcaagtgaggcgggaaaggtcgtgatcacgattgacaaccaaacctttaagaagaagaaggtgctctacaggtccaaaacccaagcataa

SEQ ID NO: 44 - protein, 683 aa, Arabdidopsis thaliana
MAQEEIQKPTASVPVVKEETPAPVKEVEVPVTTEKAVAAPAPEATEEKVVSEVAVPETEVTAVKEEEVATGKEILQSESFKEEGYLASELQEAEKNALAELKELVREALNKREFTAPPPPPAPVKEEKVEEKKTEETEEKKEEVKTEEKSLEAETKEEEKSAAPATVETKKEEILAAPAPIVAETKKEETPVAPAPVETKPAAPVVAETKKEEILPAAPVTTETKVEEKVVPVETTPAAPVTTETKEEEKAAPVTTETKEEEKAAPGETKKEEKATASTQVKRASKFIKDIFVSVTTSEKKKEEEKPAVVTIEKAFAADQEEETKTVEAVEESIVSITLPETAAYVEPEEVSIWGIPLLEDERSDVILLKFLRARDFKVKEAFTMLKNTVQWRKENKIDDLVSEDLEGSEFEKLVFTHGVDKQGHVVIYSSYGEFQNKEIFSDKEKLSKFLKWRIQFQEKCVRSLDFSPEAKSSFVFVSDFRNAPGLGQRALWQFIKRAVKQFEDNYPEFVAKELFINVPWWYIPYYKTFGSIITSPRTRSKMVLSGPSKSAETIFKYVAPEVVPVKYGGLSKDSPFTVEDGVTEAVVKSTSKYTIDLPATEGSTLSWELRVLGADVSYGAQFEPSNEASYTVIVSKNRKVGLTDEPVITDSFKASEAGKVVITIDNQTFKKKKVLYRSKTQA

SEQ ID NO: 45 - DNA, 1230 bp, Arabdidopsis thaliana
atggatgcttcattgtctccattcgatcaccaaaaaactcaaaacacagagccaaagaaaagcttcattacctcactaatcactctccgttcaaacaacatcaaagaagacacatacttcgtctcagaactcaaacccacggagcaaaaatcacttcaagaactcaaagaaaagctctcagcttcatcctccaaagcttcttcaatgtggggagtctcactcctcggtggagacgacaaagctgacgtaatcctcctcaagttcctcagagcaagagatttcaaagtagcagactctttgagaatgcttgagaagtgtttggagtggagagaagagttcaaagcagagaaattgacagaagaagatctgggttttaaagatttggaaggtaaagttgcttacatgagaggctacgacaaagaaggacacccagtttgttacaatgcttatggtgtgtttaaagagaaagagatgtatgagagagtgtttggtgatgaagagaagcttaacaagtttctgagatggagagttcaggttttggagagaggtgttaaaatgcttcattttaaacctggtggtgttaattccattattcaagttacagatcttaaagatatgcctaagagagagcttagagttgcttctaatcagatcctctctctttttcaagataattaccctgaattggttgctactaagatattcataaacgtgccttggtacttcagtgtgatctactcaatgttcagcccattcctgactcagagaacaaagagcaagtttgtgatgtccaaagaaggcaatgcagcagaaacactctacaagttcattaggccagaagatattccggtgcaatacggtggtcttagccgtcctactgattcgcaaaacggaccgccaaaaccggcgtctgaattctccatcaagggtggtgagaaagttaacattcagattgaaggcattgagggtggagcaaccataacatgggatatagtagttggaggatgggatttagagtacagtgcagagtttgttccaaacgctgaagagagttacgcgatcgttgtcgagaaaccgaagaagatgaaagctacagatgaagctgtttgcaactctttcactacagtagaagctgggaagctcattctctctgttgacaatactctctctcgcaagaagaaagttgctgcttaccgttacactgtccggaaatctactacaaccgtctaa

SEQ ID NO: 46 - protein, 409 aa, Arabdidopsis thaliana
MDASLSPFDHQKTQNTEPKKSFITSLITLRSNNIKEDTYFVSELKPTEQKSLQELKEKLSASSSKASSMWGVSLLGGDDKADVILLKFLRARDFKVADSLRMLEKCLEWREEFKAEKLTEEDLGFKDLEGKVAYMRGYDKEGHPVCYNAYGVFKEKEMYERVFGDEEKLNKFLRWRVQVLERGVKMLHFKPGGVNSIIQVTDLKDMPKRELRVASNQILSLFQDNYPELVATKIFINVPWYFSVIYSMFSPFLTQRTKSKFVMSKEGNAAETLYKFIRPEDIPVQYGGLSRPTDSQNGPPKPASEFSIKGGEKVNIQIEGIEGGATITWDIVVGGWDLEYSAEFVPNAEESYAIVVEKPKKMKATDEAVCNSFTTVEAGKLILSVDNTLSRKKKVAAYRYTVRKSTTTV

SEQ ID NO: 47 - DNA, 1623 bp, Arabdidopsis thaliana
atgactgctgaagttaaggttgaggagaaacaggtggagtcagaggttgttattgctcctgctgttgttcctgaggagactactgttaaggctgttgtggaagagactaaggttgaagaagatgagagcaagcctgagggtgtggagaagagtgcttccttcaaagaagagagtgatttctttgctgatttgaaagaatctgagaaaaaggcactgagtgatctcaagtctaagcttgaggaagctattgttgacaacactctcttaaagacgaagaagaaggagagctctcctatgaaggagaagaaggaagaggttgtgaaacctgaagctgaggttgagaagaagaaggaagaagcagcagaggagaaggttgaagaagagaagaaatctgaggctgttgttaccgaagaagcaccgaaagctgagactgttgaggctgttgttacagaggagataatccccaaggaagaagtgactactgttgttgagaaggtagaagaagaaaccaaggaagaagagaagaaaaccgaggatgttgttactgaagaagtgaaagctgagactattgaggtggaggatgaagatgagtcggtggataaggatatcgagctttggggagtgccattgcttccaagcaaaggagctgaaagcacggatgttatcctcttgaagttcttgagagcaagagactttaaagtcaacgaagcctttgagatgctgaagaaaaccctcaaatggagaaagcaaaacaagattgattcgatccttggagaggagtttggggaggatcttgccactgcagcttacatgaacggtgtggaccgcgagtcccacccagtttgttacaatgtccacagcgaggagctttaccagacgattgggtcggagaagaacagagagaagttcttgagatggaggtttcagctgatggagaagggaatccagaagcttaatcttaaaccaggaggtgttacttctcttctccagatccacgatctcaaaaacgctcctggagtgtcaagaacagagatttgggtcggaatcaagaaagtaatcgagactttgcaggacaactatccggaattcgtgtccagaaacatattcatcaacgttccattctggttctacgccatgagagctgtcctctcgccattcttaactcaacgaaccaagagcaagtttgttgtggctcgtcccgctaaggtcagagagactcttctcaagtacattccagctgatgagctcccagttcagtacggtgggttcaaaacagtagacgataccgaattctccaacgaaactgtctctgaagttgttgttaagcctggatcatctgaaaccatcgaaatcccagctcctgagactgaaggtacattggtatgggacatagcggttttgggatgggaagtgaattacaaggaagagtttgtgccaacagaagaaggagcttacacggtaatagtccaaaaggtgaagaagatgggagcaaatgaaggaccaatcaggaacagtttcaagaacagtcaggctggtaagattgttcttaccgttgacaatgtctctggcaagaagaagaaagttctgtacaggtacagaaccaagactgaatcctcttcctga

SEQ ID NO: 48 - protein, 540 aa, Arabdidopsis thaliana
MTAEVKVEEKQVESEVVIAPAVVPEETTVKAVVEETKVEEDESKPEGVEKSASFKEESDFFADLKESEKKALSDLKSKLEEAIVDNTLLKTKKKESSPMKEKKEEVVKPEAEVEKKKEEAAEEKVEEEKKSEAVVTEEAPKAETVEAVVTEEIIPKEEVTTVVEKVEEETKEEEKKTEDVVTEEVKAETIEVEDEDESVDKDIELWGVPLLPSKGAESTDVILLKFLRARDFKVNEAFEMLKKTLKWRKQNKIDSILGEEFGEDLATAAYMNGVDRESHPVCYNVHSEELYQTIGSEKNREKFLRWRFQLMEKGIQKLNLKPGGVTSLLQIHDLKNAPGVSRTEIWVGIKKVIETLQDNYPEFVSRNIFINVPFWFYAMRAVLSPFLTQRTKSKFVVARPAKVRETLLKYIPADELPVQYGGFKTVDDTEFSNETVSEVVVKPGSSETIEIPAPETEGTLVWDIAVLGWEVNYKEEFVPTEEGAYTVIVQKVKKMGANEGPIRNSFKNSQAGKIVLTVDNVSGKKKKVLYRYRTKTESSS

SEQ ID NO: 49 - DNA, 2007 bp, Arabdidopsis thaliana
atgtctcaagattctgcaactactactccgccgccacctttaacctccgacgtttcaatgccttccggtgaagaagatgagccaaagcatgtaacatcggaagaagaggcaccggtgacttcggagacaaatctgaagctacctttgatgccggagctagaggagtcaaatcatacggcggaggttgtttcagagaaggtgacgccggagacgatgactttggagtcagaaggtctcaaccacgcggcggaggattcagagcagacacatgaagtgacgccggagacagagactgcgaagctagaggttctcaaccacacggcggaggattcagagcagacacatgaagtgacgccggagaaagagactgtgaaatcagagtttctcaaccacgtggcggaggattcagagcagacacatgaagtgacgccggagacagagactgtgaagtcagaggttctcaaccatgcggcggaggattcagagcagccacgtggagtgacaccgacgccggagacagaaacatcggaggcagacacgtcattgcttgtaacttccgagacagaagagcctaaccatgcggcggaggattattcagagacagagccatcacagaaactaatgttggagcagaggagaaagtacatggaagtagaagattggacagagccagaactaccagatgaagcggtgttagaagctgcagcgtcagtccctgagccaaagcaaccagagcctcagacaccaccaccaccaccatctactactacttccactgttgcatctagatctttagccgaaatgatgaacagagaagaagcagaagtagaagagaaacaaaagattcagattcctcgtagtctcggttcattcaaagaagaaacaaacaaaatctccgatctttcagaaacagagttaaacgcacttcaagagcttcgtcaccttcttcaagtatcacaagattcaagcaaaacctctatatggggtgtgccacttctcaaagacgacagaaccgacgtcgttttgttaaagtttctaagagcaagagactttaaacctcaagaagcttactcaatgctaaacaagacactccaatggagaatcgacttcaacatcgaagagcttctagacgaaaacctcggtgacgatttagacaaagttgtgttcatgcaaggacaagacaaggagaatcatcctgtctgttacaatgtctacggtgagtttcagaacaaagatctttatcagaaaacgttttcagatgaagagaagagagaacggttcttgagatggaggattcagtttcttgaaaagagtatcaggaatcttgattttgtagctggtggtgtttccacgatatgtcaagtaaatgatcttaagaattctccaggacctggtaagactgagcttaggttagctactaagcaagctcttcatcttcttcaagacaattaccctgagtttgtctctaaacagatattcatcaatgttccatggtggtaccttgcgttctatagaattattagtccttttatgtcacaaaggtcaaagagcaaactagttttcgcaggtccttcaagatctgcagaaacccttctcaagtacatatcacccgaacatgtcccggttcagtatggtggactaagtgtggataattgcgagtgtaactcggatttcacacacgatgatatcgctaccgagattactgttaaaccaactactaaacaaaccgtcgagattattgtttacgagaaatgtacaatcgtgtgggagataagagtagtgggatgggaggtttcgtatggagcggagtttgtgccggagaacaaagaagggtatacagtgatcattcagaaaccgaggaagatgactgcgaaaaatgaactggtggtgtctcatagcttcaaagttggagaagttggcaggattttgctaactgttgataacccgacttcgaccaagaaaatgcttatctacaggttcaaggttaagcctttagcttgtgagtaa

SEQ ID NO: 50 - protein, 668 aa, Arabdidopsis thaliana
MSQDSATTTPPPPLTSDVSMPSGEEDEPKHVTSEEEAPVTSETNLKLPLMPELEESNHTAEVVSEKVTPETMTLESEGLNHAAEDSEQTHEVTPETETAKLEVLNHTAEDSEQTHEVTPEKETVKSEFLNHVAEDSEQTHEVTPETETVKSEVLNHAAEDSEQPRGVTPTPETETSEADTSLLVTSETEEPNHAAEDYSETEPSQKLMLEQRRKYMEVEDWTEPELPDEAVLEAAASVPEPKQPEPQTPPPPPSTTTSTVASRSLAEMMNREEAEVEEKQKIQIPRSLGSFKEETNKISDLSETELNALQELRHLLQVSQDSSKTSIWGVPLLKDDRTDVVLLKFLRARDFKPQEAYSMLNKTLQWRIDFNIEELLDENLGDDLDKVVFMQGQDKENHPVCYNVYGEFQNKDLYQKTFSDEEKRERFLRWRIQFLEKSIRNLDFVAGGVSTICQVNDLKNSPGPGKTELRLATKQALHLLQDNYPEFVSKQIFINVPWWYLAFYRIISPFMSQRSKSKLVFAGPSRSAETLLKYISPEHVPVQYGGLSVDNCECNSDFTHDDIATEITVKPTTKQTVEIIVYEKCTIVWEIRVVGWEVSYGAEFVPENKEGYTVIIQKPRKMTAKNELVVSHSFKVGEVGRILLTVDNPTSTKKMLIYRFKVKPLACE

SEQ ID NO: 51 - DNA, 1542 bp, Populus trichocarpa
gactcagtactaacatctgaatctgatgttagtactgagattaaaccaccagcagagactcaggaatcaaaagttgaagaaaccccagaaaaagaatcacaagaagtggcaaaagaagagcaaaaggctgcaccttcaccagaggagatcactatatgggggatccctcttctgaaagatgatagaagtgatgtggttctcttgaagttcttgagggcaagggattttaaggtaagcgatgcatttgtaatgatcaagaacacaattcaatggaggagagactttaaaattgatgagcttgttgatgaagatctaggtgatgatttggagaaagttgtgtttatgcatggttatgacagggaagggcatcctgtgtgttataatgtgtatggggagtttcaaaataaagagttgtatcagaagacattctctgatgaggagaaaagattgaagtttttgaggtggcggattcagttcttggagaggagtattaggaagcttgattttagtcctagtggtatttccaccgtcttccaggttaatgatctcaagaactctccaggacccggaaagagagagcttaggttggctactaaacaggctctcctattgcttcaggacaattaccctgagtttgtggccaaacaggtgttcatcaatgtcccttggtggtatcttgcattttatacaatgatcagtccatttatgacacaaagaaccaaaagcaaatttgtattcgcaggcccatcaaaatctgctgagacacttttcaaatatgtatctcctgagcaagttcctattcagtatggtggcttgagcgtggatttctgcgactgcaaccccgaatttacttttgctgatcctgctactgagataactgtaaaaccagcaaccaagcaaactgtggaaattataatttatgagaaatgtttcattgtttgggagttgcgagttgttggatgggaggtgagttatagtgctgaattcgtgcccgattctaaagatgcatacacaattataatgacaaaacccacaaaaatgaccccaaccaatgagccagtggtgtctaacagcttcaaagttggtgagctgggaaaaatattgctcacagttgacaactctacctcaaagaagaagaaacttctctacaggttcaagataaaccccttctcagattgaggaactctttgtatttaatgtttccatctcagatagttgtggaaattgaattaattttatgtactctgggtgagccttttgtctctcgtcttttttctctaccgaatagcacatggtttgcattcggtgttttttttgccaatcatcttggggaaaacaaacagatgtgtgggcatatggaggggggtgtggttgtgaaacttatatatacataaatgtgccatttcattgaggcgttttgcgatgcgctttctcgtttatctggatgtcaatatttcagtaccatttacctttatgtaatctcaaaactcttatgttattgcgacatcgaatacttcaatttgacatcatctttaaagttga

SEQ ID NO: 52 - protein, 309 aa, Populus trichocarpa
MIKNTIQWRRDFKIDELVDEDLGDDLEKVVFMHGYDREGHPVCYNVYGEFQNKELYQKTFSDEEKRLKFLRWRIQFLERSIRKLDFSPSGISTVFQVNDLKNSPGPGKRELRLATKQALLLLQDNYPEFVAKQVFINVPWWYLAFYTMISPFMTQRTKSKFVFAGPSKSAETLFKYVSPEQVPIQYGGLSVDFCDCNPEFTFADPATEITVKPATKQTVEIIIYEKCFIVWELRVVGWEVSYSAEFVPDSKDAYTIIMTKPTKMTPTNEPVVSNSFKVGELGKILLTVDNSTSKKKKLLYRFKINPFSD

SEQ ID NO: 53 - DNA, 1080 bp, Populus trichocarpa
gggaggattcaattcctggaaaaaagtatcaggacattggatttcagtcccggtggaatttccacaattgttcaggttaatgacttgaaaaattctcctggaccagctaagagagagcttagacaagctactagacaggcacttcaattgcttcaagacaactatccagaatttgtggccaaacagatcttcatcaatgttccctggtggtacctaacagtaaatagaatgataagtccatttttaacccagaggaccagaagcaagtttgtctttgttggtccttccaaatctgccgaaacccttatcaggtacatagccgctgagcaaataccagtgaagtacggaggactaagcaaagatggtgaatttggctcagctgatgttgttactgagattaccgtgaagccagcagcaaagcacactgtagaattcccagttactgagacatgccttttaacatgggaagtgagagttgcgggatgggatgtgagctatagtgcagaatttgtaccaagtgctgaagatagctacacagtgatcatccaaaaggctagaaaggttgctgcaactgaagaaccagtggtttgcaacagtttcaaaattggtgaacctggtaaagttgttctcaccattgacaactccacatccaagaagaagaagaagctcctctatcgcttgaaaaccaagcccgcttcttctgattaattaagggactatatatattgaaacaacaatagaagattttgcttacattcttgctgctgctgctgctgccaattttatcaacatgatcatatcacagcttgaaggtgttctgagggtcttgatcatggagaagataaagaaatcttgaagatgtttatttatatgtttatttataattgaattttgttttggtgtggaatggattaaggatgttgtgcaattgaaggctagaagcatgtatggggatagggaagaagctccattactagtgccaagaattttctttgtaaattctttatggctttctttctctttccctgtaagtatcttttggacatattatgatattaatgaagacagtatctttcctat

SEQ ID NO: 54 - protein, 159 aa, Populus trichocarpa
MISPFLTQRTRSKFVFVGPSKSAETLIRYIAAEQIPVKYGGLSKDGEFGSADVVTEITVKPAAKHTVEFPVTETCLLTWEVRVAGWDVSYSAEFVPSAEDSYTVIIQKARKVAATEEPVVCNSFKIGEPGKVVLTIDNSTSKKKKKLLYRLKTKPASSD

SEQ ID NO: 55 - DNA, 911 bp, Populus trichocarpa
atgtgttcatcaatgttccatggtggtacctaacattcaataagatgatcagccctttcctgacacacaggacaaagagcaagtttgtttttgctggcccatccaagtctgctgaaacacttttcaaatacatagctcctgaagaagtgccagttcaatatggtggactaagcaaggatggcgaattcacaggtgccgataccgtcacagatgttactattaagccaacatcaaagcacactgttgagttcccagtgtctgaggcatgtgttctcgtttgggagcttcgagtttttggttgggatgtgagctatggagctgaattcgtgcctagcgctgaggatggttacaccgttatcgtatcaaagaccaggaagattatctcatccgatgatcctgtgatctcagacacattcaaaattggtgaacctggcaaggttgtgcttaccattgataaccaaacctctaagaagaagaagctcctctataggtcaaagaccaaacccctttctgaatgagcttcaagaatcaatgccttcgtggggttttgaacttccattaatttagaagacatggatggcataacaaggggtccttggtcatgatgcatgaacacgaggtgtggagttttgttctgtttaaatttaatatattttttgttttataaagtctgggtttgggctgggatttgttgtttggtgtttaattggatacaatgtactggtgaagacagtctgggattatcatggattgacagacacatttgaggtttaagtgtgaagaatatgaaaatgtgtttgccaaagttgaaagactatccttttttgttcttggtactcttacctgtaaaatttgtgtaaatgtgatggtgttctacttcttccttcttaattaatacatgtattttttac

SEQ ID NO: 56 - protein, 157 aa, Populus trichocarpa
MISPFLTHRTKSKFVFAGPSKSAETLFKYIAPEEVPVQYGGLSKDGEFTGADTVTDVTIKPTSKHTVEFPVSEACVLVWELRVFGWDVSYGAEFVPSAEDGYTVIVSKTRKIISSDDPVISDTFKIGEPGKVVLTIDNQTSKKKKLLYRSKTKPLSE

SEQ ID NO: 57 - DNA, 840 bp, Populus trichocarpa
actagtttaattaaattaatccccccccccgtggtattgcttctttgcttcaaatcagtgatctcaagaattctccttccccatcaaagaaagagctcaggactgccatgagcaaagctgtcacccttttgcaggacaattatccagaatttgttgcaaaaaatatattcataaatgttccattttggtattatgctttcaacgccctgctatctcctttcttggctcaaagaaccaagagcaaatttgtcgttgttcgccctgccaagaccaccgagacattgctcaagtatgttcaggccgaggaaatccctgtccaatatggtggcttcaagagggagaatgatttcgagttctccagcgaagatggtgaagtttcagaacttgtaatcaaagctggatcaactgaaaccattgagatccctgcagcagaggttggagccacattgctttgggacctgacagttgtgggatgggaagtgaattacaaggaggaatttgtgccaagtgatgaagcttcctacaccatcatcatccaaaagggcaagaaaatgagctcaaatgaagagccaactcgcaacactttcaggaacaatgaacctggaaaggtagttctgaccattcagaattggtcaagcaagaagaagagggtcctataccgatacaagaccaagaagaatgcttcctattgagacaagactccattcttttatattatcagtcttttatttgccgtgacaattcttttctagatagaaaacattgattcttttcaggattgatatctatatctatatctgatcgtgtgatttgatttgttatttctggggttcctttttc

SEQ ID NO: 58 - protein, 194 aa, Populus trichocarpa
MSKAVTLLQDNYPEFVAKNIFINVPFWYYAFNALLSPFLAQRTKSKFVVVRPAKTTETLLKYVQAEEIPVQYGGFKRENDFEFSSEDGEVSELVIKAGSTETIEIPAAEVGATLLWDLTVVGWEVNYKEEFVPSDEASYTIIIQKGKKMSSNEEPTRNTFRNNEPGKVVLTIQNWSSKKKRVLYRYKTKKNASY

SEQ ID NO: 59 - DNA, 1564 bp, Lycopersicum esculentum
ggagaaagtaactccaccggaaactgaagcaactccggcgccggcagcagagacaccatctgagccatcggagacagagaaggtggaggcagtcgaggaaatcaaggaaaccattgttgaagtaccggctgcggttgctgtgatggcctccacggaggagccaccggctgcagaggcagaggaaccgaaaacagagcaaaccccaccagcagcaccagaagaagtatccatatggggaataccccttttagcagatgagagaagtgatgtaatccttctcaagtttctgcgagcgagagatttcaaggtgaaagaagctttcaccatgttgaaaagtgttgtcgcatggagaaaagaattcaagattgatgaactcttggatgagaaagaattaggacaaggacttgaaaaagttgtttacaatcacggagtagacaaagaaggtcaccctgtatgttacaatgcatttggtgagttccaagacaaagaattgtaccaaaacacttttgctgatgacaaagagaaactcaccaaattcctcagatggagaattcaattcatggagaaatccatcaggaatcttgattttagccctgatggtatcaacacttttgttcaagttcttgatctgaagaattcacctggactcttcttttacaagaaagaacttcgccaagccaccaatcgtgcccttctattactccaggataattaccctgaatttgttgccaagcaggtgttcatcaatgttccatggtggtacccagcttactacaggatgattaatgcatctttcactacaaggaccaagagcaagtttgtttttgctggtccttcaagatctgctgatactctattcaaatacatagcacctgaacaagtaccagcacaatatggtggacttagcaaggagggtgaagaggaattcaccactgctgaaccagccactgaggaaatcattaagccagcttctaaacacaccattgaattcccagttactgagaaaagcacattggtttgggaagcaagagtgacagggtgggatgtatcatatggagctgaatttgtgcctagtgctgaaggtggctacaccattctcatagagaaatcaagaaaagttggggcaaatgaatcagtgatcagcactagctacaaggcaagtgaagcaggcaaagtggtaatcacaattgacaaccaaacttctaaaaagaagaaacttgtttacaggtccaagaacaagatctcagattgctgagccgccttttcttgtttcatagatttttcttttggttgatatcaactagtactattattttgagctttttgggggtatttatttatattttattggggttattttttgagctattttgctgttggattgttttttttattatatggggaatatttattatattacaaaggggttgagatgtggagtacaagttattgatacattttcttctgaaatattttgtgtaaatctaatgctgcctctcattttccttacatttttttggtgatgtgaagcttaacgttagttaatcctatacttatgtttcct

SEQ ID NO: 60 - protein, 370 aa, Lycopersicum esculentum
MASTEEPPAAEAEEPKTEQTPPAAPEEVSIWGIPLLADERSDVILLKFLRARDFKVKEAFTMLKSVVAWRKEFKIDELLDEKELGQGLEKVVYNHGVDKEGHPVCYNAFGEFQDKELYQNTFADDKEKLTKFLRWRIQFMEKSIRNLDFSPDGINTFVQVLDLKNSPGLFFYKKELRQATNRALLLLQDNYPEFVAKQVFINVPWWYPAYYRMINASFTTRTKSKFVFAGPSRSADTLFKYIAPEQVPAQYGGLSKEGEEEFTTAEPATEEIIKPASKHTIEFPVTEKSTLVWEARVTGWDVSYGAEFVPSAEGGYTILIEKSRKVGANESVISTSYKASEAGKVVITIDNQTSKKKKLVYRSKNKISDC

SEQ ID NO: 61 - DNA, 2297 bp, Medicago truncatula
ttatacataaaacacatcaacccaagcccaattgtctccaactccaactccaaacccatcatctcactctctctatattagtcttttctcaatacccaaatatcactttttcttaaccttaaccttaaccctaatatcatctcactcttttttcatatcaaatggctgctgaacctcaaaaacctgctgaagaagttgccacaaccacctctgaaactgttgttgagaaagaacaacaggctgatggagttgtagctgctgctgttaccgctgccgctgttaccgctgccaccactgataaggaagctgttgctgatcctcctcctgctgttgctgatgaggctgagaagccggcggaagttgtggctgataaggtggcggatgaaactgttgttgatgaaagcaaggtttctcaatcggtttcttttaaggaagaaactaacgtggtttctgaacttcctgacgttcagaaaaaagcacttgatgaacttaaacaacttattcaagaagcgcttaacaaacatgaattcaccgctcctccacccgctccagtcaaagcacctgaacctgaagtagctgtaaaagaagagaaaaagcctgaagaagatgaaaagaaaaccgaagaggtggtagaagagaagaaagatgaagcagtagttgaggagaagaaggttgatgaagaaaaaggttcaacctctgaggaacctaaagttgaaactgctgaacctgaaaaggaggagaagaaagtggaggaaacggttgtagaagttgttgagaaaatagctgcaagtaccgaagaagacggtgcgaaaacagttgaggctattcaggaaagtatagtatctgttccagttactgaaggtgaacaacctgttgctgagcctgttgctgaagtggaggttactcctattgtaccagaagaagttgaaatatggggaattccattactagctgatgaaagaagtgatgtgattcttctcaagttcttgagagctagggattttaaggtgaaggaggctttcactatgatcaaacaaaccgtgctttggcgaaaggaattcggagtcgaagcacttcttcaagaagatcttggaactgactgggacaaagttgttttcactgatggtactgacaaagaaggtcaccctgtttattacaatgtttttggtgagtttgaggataaggatttgtatcaaaaaacattctctgatgaagagaagagaaccaagttcgttcgttggtggattcagtctttggagaaaagtgttaggaaactcgactttgctccatctggtatctctactcttgttcagattaatgatcttaaaaattctcctggacttcttggtaagaaagagcttagacaatctattaagcagactcttcagttgcttcaggataactatcctgaatttgttgccaaacagattttcatcaatgttccttggtggtaccttgccttctctaggatgatcagtcctttcctgacacaaaggactaagagcaaatttgtatttgctggttcctccaaatctgctgaaacccttttcaaatatatagctcctgagcaagtgccagttaaatatggaggactgagcagagacggtgaacaggaattcaccactgctgaccctgctacagaggttactatcaaaccagcaactaaacatgctgttgagttcccagtttctgagaaaagcactttggtttgggaagtaagagttgtggattggaatgtgagctatggagcagaatttgtgcctagtgctgaagatggatacactgtgataatccagaagaacaggaaaattgctgcagctgatgaaacagtaattagcaacaccttcaaagttggtgaacctggaaaagttgtactcaccattgataaccaaacatccaagaaaaagaagctgctttacaggtccaagaccatacccatctctgagtaaaaggaaaaatgtttaaattcattatatggtcaataacattattgtgaaggttattgggtgggttacttatattcttttataggaatattttcttcatttggtttgtaaattattttgtttcaagtatggggttgggaaattttatttacagttattatcacttatcaatattcttaaattaatgtggtattttgttcttttgtgttggaattggatgaaacctttgctggatgaagaacacaattgggttcttttgtaaaacaaaagtttattgtttttgttatcttgtgactctgtgattgaaggatttatttgagtaatttttttattccaattagtctagtggcc

SEQ ID NO: 62 - protein, 595 aa, Medicago truncatula
MAAEPQKPAEEVATTTSETVVEKEQQADGVVAAAVTAAAVTAATTDKEAVADPPPAVADEAEKPAEVVADKVADETVVDESKVSQSVSFKEETNVVSELPDVQKKALDELKQLIQEALNKHEFTAPPPAPVKAPEPEVAVKEEKKPEEDEKKTEEVVEEKKDEAVVEEKKVDEEKGSTSEEPKVETAEPEKEEKKVEETVVEVVEKIAASTEEDGAKTVEAIQESIVSVPVTEGEQPVAEPVAEVEVTPIVPEEVEIWGIPLLADERSDVILLKFLRARDFKVKEAFTMIKQTVLWRKEFGVEALLQEDLGTDWDKVVFTDGTDKEGHPVYYNVFGEFEDKDLYQKTFSDEEKRTKFVRWWIQSLEKSVRKLDFAPSGISTLVQINDLKNSPGLLGKKELRQSIKQTLQLLQDNYPEFVAKQIFINVPWWYLAFSRMISPFLTQRTKSKFVFAGSSKSAETLFKYIAPEQVPVKYGGLSRDGEQEFTTADPATEVTIKPATKHAVEFPVSEKSTLVWEVRVVDWNVSYGAEFVPSAEDGYTVIIQKNRKIAAADETVISNTFKVGEPGKVVLTIDNQTSKKKKLLYRSKTIPISE

SEQ ID NO: 63 - DNA, 1510 bp, Beta vulgaris
  misc_feature (2)..(3): n is a, c, g, or t
tnncccgggctgcaggaattcggcacgagctcatttctctacatcaaaaacacaacaaagagatcacccatggcggaagaaacccataagccagaatcaacggtggctgaagtggtggttccagtagccgagaaaccagctgagaagccagctgagaaggcagttctaccacctgaagctgagaaactagctgcagctgaatcagctgaagccgagaagccagctgattcagccgaggctaagatagctcaacaagtctcattcaaagaggagactaatgttgcaagtgagctacctgagctacatagaaaggctctcgaggacttgaagaaacttattcaagaagccctcgagaagcacgagttctcttctcctcctcctccgcctccgcctgctccagctaaagttgaggagaaggcggaagagaagaaagaggaacaacctccatccaccacctccaccaccaccaccaccaccaccgcggtttcagatgaggttgctgttgctcctccatccgaagaggccccgaaaactgacgaggcctctccgaaagtggaggaggagcctgcaaaaatagttgagcaaccacctacaacaccggcagaagaacctgaaccagcaaaaacacctgaggttgttgttgctgaagaggagaaaactggtgaggatattaaagaaactatagtagtcgaggttgcgacaactacagcagcaccagtactaacagaaccagaatctgttgaggagacaccaaaagaagctgaagttgtagtggaagaatcaccaaaggagccagaagaagtatcaatatggggaattccacttcttgctgatgaaagaagtgatgtaattctattgaaattcttaagagcaagagattatagagtgaaagatgctttcactatgattagaaatactgctcgttggagaaaagaatttgaggttgattctttacttgatgaagatcttggaaatgattatgagaaagttgtttttacacatggagttgataaacaaggtcgtcctgtttgttataatgtgtttggagagtttcaaaataaggaactttatcagaatactttctctgatgcagaaaaaaggaaaaagttcttgagatggttgattcaattccttgaaaaaactattagaactcttgattttagtcctgaaggaattaattcttttgttcttgttaatgatttgaagaattctcctgggtatggtaagagagatctttacaaagttattgacaagtttcttgagattctccaggataattacccagaatttgctgctaaacagttgtgcatcaatgtttcatggtggtcttggcatacaactggatctatttgactgtatttacaccaaggagcaagagcaagtttgtgtttgcaagcccatctaaaactgctgagacccttttcaagtacatagctcctgagcaggtgcctgttcaatttggtgggcacagcaagtttggcgagcatgagttttcccctgctgatactgt

SEQ ID NO: 64 - protein, 427 aa, Beta vulgaris
MAEETHKPESTVAEVVVPVAEKPAEKPAEKAVLPPEAEKLAAAESAEAEKPADSAEAKIAQQVSFKEETNVASELPELHRKALEDLKKLIQEALEKHEFSSPPPPPPPAPAKVEEKAEEKKEEQPPSTTSTTTTTTTAVSDEVAVAPPSEEAPKTDEASPKVEEEPAKIVEQPPTTPAEEPEPAKTPEVVVAEEEKTGEDIKETIVVEVATTTAAPVLTEPESVEETPKEAEVVVEESPKEPEEVSIWGIPLLADERSDVILLKFLRARDYRVKDAFTMIRNTARWRKEFEVDSLLDEDLGNDYEKVVFTHGVDKQGRPVCYNVFGEFQNKELYQNTFSDAEKRKKFLRWLIQFLEKTIRTLDFSPEGINSFVLVNDLKNSPGYGKRDLYKVIDKFLEILQDNYPEFAAKQLCINVSWWSWHTTGSI

SEQ ID NO: 65 - DNA, 552 bp, Chlamydomonas reinhardtii
gtcgtgctactcaagttcttgcgcgcacggcagtggaacgtggcggccgcagttaacatgcttgtcaactgtctgcggtggcggcgcgacttcgacgtggccggcctcggcctggagaccttcccgccgcagctggcggcggcggggcagctcaccggacacgaccgggccggcaacccagtcacctacaactactacggcacgggtgtggacttgaacgcggtgatgggcagcccgggcggtgtggccaccttcgtgcggtggcgggtgcggctgatggagcaggcgattgcgcagctggacttcgagcgcggcgtggagcacgtcacgcagatccacgactacgccggcgcctccatgttccgcatggacgcgggcatcaagtccgccagccgcgagatcatacgactgttccaggacaactatcccgaactgctgtccgccaagctgttcctcaacgtgccgcgggtcatggagttcctgttcggcgtgttcagcggcctggcggacgccgccacccgcgccaagttcaccatggcctcgcccgcccgc

SEQ ID NO: 66 - protein, 184 aa, Chlamydomonas reinhardtii
VVLLKFLRARQWNVAAAVNMLVNCLRWRRDFDVAGLGLETFPPQLAAAGQLTGHDRAGNPVTYNYYGTGVDLNAVMGSPGGVATFVRWRVRLMEQAIAQLDFERGVEHVTQIHDYAGASMFRMDAGIKSASREIIRLFQDNYPELLSAKLFLNVPRVMEFLFGVFSGLADAATRAKFTMASPAR

SEQ ID NO: 67 - DNA, 1335 bp, Dictyostelium discoideum
atgagtggatttattaaagatttatctcaacctcaaagtgaagctttaaatcaatttaaagaatatttaaataaaaaagaaacaattgtgcaaattaaatcagatattaaaaataaattaccaacaactacaacaactacaacaactactaatacagaaacagaagaatcatcatcatcatcatcaccatcatcaaaagaagaagaaaaacacttaaaaatttggaatattaatttagaaaatgattcaaaagagcgtgatattattttattaaaatttttacgtgctagagaatttaaaattgaaaattcaaaacaaatgttaattgattgtttaatttggagaaaacaaaatcaagtagatgattatgaaaagatagttaatgaagcatttccagactattataaaaacattggtaccattttcaagactgataaagagggtagaccagtaatgatcaatcattaccatgcaattaatccagatgttattttcaaagatggtgtggaccaatttgttcgttggaaagtccaacaaatggaaatcgccattagggatacactcatcccatcgcaatgggaaattgaagatttaatagtcattcacgactataaagattgctcattctttagaatggatccacgtataaaacaagcatctaatcaaaccattcaaacccttcaaaataactacccagaatttttagctcgtaaattctttattaacatcccatggttaatggagaagttgttctcaattttcacagtattcacatcagagcgtacaaaaagcaaattcataatttgttctggaaattatcgggaaaaacttttaaaatatattgaagcagattcaatcgctccaaaattatctggtttcgaagataaccaatcaccaattttaaatattaaaatcaaacctcaaaaatcacattcaattcaattaggtaaacttgatgctgataaaactattgaatgggaattttgtacaaatgagattgattctgaaattggtgctaaaattttaattgaaccaaataaccaaccaacaacttctaatgatattttatattttaataataatagtaataataataataataataataattcaccaacaccaagtaatagtaattatccattcaattgttttctttcaattgaaccaagagaatttaatagtggttcaattcaaattgaagatgattcttattatactttagtttttaataatcatttaaataaacaatgtgatttattttatcgtataactataaaatcaaaaacaactcattcttcaactacaacttcaacaatcgaaactttaggaaattaa

SEQ ID NO: 68 - protein, 444 aa, Dictyostelium discoideum
MSGFIKDLSQPQSEALNQFKEYLNKKETIVQIKSDIKNKLPTTTTTTTTTNTETEESSSSSSPSSKEEEKHLKIWNINLENDSKERDIILLKFLRAREFKIENSKQMLIDCLIWRKQNQVDDYEKIVNEAFPDYYKNIGTIFKTDKEGRPVMINHYHAINPDVIFKDGVDQFVRWKVQQMEIAIRDTLIPSQWEIEDLIVIHDYKDCSFFRMDPRIKQASNQTIQTLQNNYPEFLARKFFINIPWLMEKLFSIFTVFTSERTKSKFIICSGNYREKLLKYIEADSIAPKLSGFEDNQSPILNIKIKPQKSHSIQLGKLDADKTIEWEFCTNEIDSEIGAKILIEPNNQPTTSNDILYFNNNSNNNNNNNNSPTPSNSNYPFNCFLSIEPREFNSGSIQIEDDSYYTLVFNNHLNKQCDLFYRITIKSKTTHSSTTTSTIETLGN

SEQ ID NO: 69 - protein, 8 aa, Artificial sequence
  Conserved motif 1 of a PATL polypeptide
  VARIANT (2)..(2): / replace = "Thr"
LLKFLRAR

SEQ ID NO: 70 - protein, 8 aa, Artificial sequence
  Conserved motif 2 of a PATL polypeptide
  VARIANT (1)..(1): Xaa can be Leu or Phe
  VARIANT (2)..(2): Xaa can be Gln or Glu
XXDNYPEF

SEQ ID NO: 71 - protein, 169 aa, Artificial sequence
  SEC domain
LPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFK

SEQ ID NO: 72 - protein, 102 aa, Artificial sequence
  GOLD domain
SDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKV

SEQ ID NO: 73 - DNA, 51 bp, Artificial sequence
  primer 1
ggggacaagtttgtacaaaaaagcaggcttaaacaatggcggaggagccac

SEQ ID NO: 74 - DNA, 50 bp, Artificial sequence
  primer 2
ggggaccactttgtacaagaaagctgggtgtggtgaatctggtgatcagg

SEQ ID NO: 75 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 76 - DNA, 1182 bp, Arabidopsis thaliana
atggcggagatacagtcaaatggaagggcatatgagtcattattggaaaaggttctttcaatgaacattctttcttctgactattttaaagagctctatggtttaaagacttatcatgaggtaattgatgaaatctacaaccaagttaatcatgtggagccgtggatgggtgggaattgccgtggtccttcaacagcgtattgtcttctctacaaattctttaccatgaaacttacagtgaagcagatgcatggactgttaaagcacacagattctccttatattagagcggttggattcctatatttaagatatgttgcagatgcaaagacgttgtggacatggtatgaaccatacattaaagatgatgaggagttttcaccaggaccaaatggacggatgacgacaatgggtgtttatgtacgtgatttgctgcttggactgtactactttgatactttgtttcctcgtatacctgttcctgtcatgcgccagattgtatcaaaccttgagaagatgaatttaccaactaaaccttctggttcaaccggagacatgacccgtggctcagaagacactgcccgtcgtccaccatcagtaaaagcatccctctctgcttcatttggtcagcgtgcacctcatcgtgcttccaccagaggctcttctcctgttcgccgtcctccaccgactggttatgacagaaatggaggcgatgaagtacaacagcggtccccacgtagaagccagagccgagactattattctgacagagactcagatagacaacgggaaagagagagggagaaagaccgcgaaagagagagggggagggatagatacagagaaagggaaagggattatggtaatgataggagatcaaggcgtgactatgatagtagaagcaggcgcaatgattatgaggacgacagaagtagacatgaccggagaagcaggagcagaagcagaagtaggagcaggagtgtgcagattgagcgtgaaccgactcctaaaagagatagtagcaacaaagagaaatcggcggtgacagtgaacagcaatctcgcaaagctaaaagatttgtatggagacgcaagtagtcagaaaagggatgaaggatttggaacaaggaaagattcaagttcagaagaagtgataaagcttggtggttcctcttggaggtga

SEQ ID NO: 77 - protein, 393 aa, Arabidopsis thaliana
MAEIQSNGRAYESLLEKVLSMNILSSDYFKELYGLKTYHEVIDEIYNQVNHVEPWMGGNCRGPSTAYCLLYKFFTMKLTVKQMHGLLKHTDSPYIRAVGFLYLRYVADAKTLWTWYEPYIKDDEEFSPGPNGRMTTMGVYVRDLLLGLYYFDTLFPRIPVPVMRQIVSNLEKMNLPTKPSGSTGDMTRGSEDTARRPPSVKASLSASFGQRAPHRASTRGSSPVRRPPPTGYDRNGGDEVQQRSPRRSQSRDYYSDRDSDRQREREREKDRERERGRDRYRERERDYGNDRRSRRDYDSRSRRNDYEDDRSRHDRRSRSRSRSRSRSVQIEREPTPKRDSSNKEKSAVTVNSNLAKLKDLYGDASSQKRDEGFGTRKDSSSEEVIKLGGSSWR

SEQ ID NO: 78 - DNA, 1182 bp, Arabidopsis thaliana
atggcggagatacagtcaaatggaagggcatatgagtcattattggaaaaggttctttcaatgaacattctttcttctgactattttaaagagctctatggtttaaagacttatcatgaggtaattgatgaaatctacaaccaagttaatcatgtggagccgtggatgggtgggaattgccgtggtccttcaacagcgtattgtcttctctacaaattctttaccatgaaacttacagtgaagcagatgcatggactgttaaagcacacagattctccttatattagagcggttggattcctatatttaagatatgttgcagatgcaaagacgttgtggacatggtatgaaccatacattaaagatgatgaggagttttcaccaggatcaaatggacggatgacgacaatgggtgtttatgtacgtgatttgctgcttggactgtactactttgatactttgtttcctcgtatacctgttcctgtcatgcgccagattgtatcaaaccttgagaagatgaatttaccaactaaaccttctggttcaaccggagacatgacccgtggctcagaagacactgcccgtcgtccaccatcagtaaaagcatccctctctgtttcatttggtcagcgtgcacctcatcgtgcttccaccagaggctcttctcctgttcgccgtcctccaccgactggttatgacagaaatggaggcgatgaagtacaacagcggtccccacgtagaagccagagccgagactattattctgacagagactcagatagacaacgggaaagagagagggagaaagaccgcgaaagagagagggggagggatagatacagagaaagggaaagggattatggtaatgataggagatcaaggcgtgactatgatagtagaagcaggcgcaatgattatgaggacgacagaagtagacatgaccggagaagcaggagcagaagcagaagtaggagcaggagtgtgcagattgagcgtgaaccgactcctaaaagagatagtagcaacaaagagaaatcggcggtgacagtgaacagcaatctcgcaaagctaaaagatttgtatggagacgcaagtagtcagaaaagggatgaaggatttggaacaaggaaagattcaagttcagaagaagtgataaagcttggtggttcctcttggaggtga

SEQ ID NO: 79 - protein, 393 aa, Arabidopsis thaliana
MAEIQSNGRAYESLLEKVLSMNILSSDYFKELYGLKTYHEVIDEIYNQVNHVEPWMGGNCRGPSTAYCLLYKFFTMKLTVKQMHGLLKHTDSPYIRAVGFLYLRYVADAKTLWTWYEPYIKDDEEFSPGSNGRMTTMGVYVRDLLLGLYYFDTLFPRIPVPVMRQIVSNLEKMNLPTKPSGSTGDMTRGSEDTARRPPSVKASLSVSFGQRAPHRASTRGSSPVRRPPPTGYDRNGGDEVQQRSPRRSQSRDYYSDRDSDRQREREREKDRERERGRDRYRERERDYGNDRRSRRDYDSRSRRNDYEDDRSRHDRRSRSRSRSRSRSVQIEREPTPKRDSSNKEKSAVTVNSNLAKLKDLYGDASSQKRDEGFGTRKDSSSEEVIKLGGSSWR

SEQ ID NO: 80 - DNA, 1158 bp, Arabidopsis thaliana
atggcggagatacagtcaaatggaagggcatatgagtcattattggaaaaggttctttcaatgaacattctttcttctgactattttaaagagctctatggtttaaagacttatcatgaggtaattgatgaaatctacaaccaagttaatcatgtggagccgtggatgggtgggaattgccgtggtccttcaacagcgtattgtcttctctacaaattctttaccatgaaacttacagtgaagcagatgcatggactgttaaagcacacagattctccttatattagagcggttggattcctatatttaagatatgttgcagatgcaaagacgttgtggacatggtatgaaccatacattaaagatgatgaggagttttcaccaggatcaaatggacggatgacgacaatgggtgtttattactactttgatactttgtttcctcgtatacctgttcctgtcatgcgccagattgtatcaaaccttgagaagatgaatttaccaactaaaccttctggttcaaccggagacatgacccgtggctcagaagacactgcccgtcgtccaccatcagtaaaagcatccctctctgtttcatttggtcagcgtgcacctcatcgtgcttccaccagaggctcttctcctgttcgccgtcctccaccgactggttatgacagaaatggaggcgatgaagtacaacagcggtccccacgtagaagccagagccgagactattattctgacagagactcagatagacaacgggaaagagagagggagaaagaccgcgaaagagagagggggagggatagatacagagaaagggaaagggattatggtaatgataggagatcaaggcgtgactatgatagtagaagcaggcgcaatgattatgaggacgacagaagtagacatgaccggagaagcaggagcagaagcagaagtaggagcaggagtgtgcagattgagcgtgaaccgactcctaaaagagatagtagcaacaaagagaaatcggcggtgacagtgaacagcaatctcgcaaagctaaaagatttgtatggagacgcaagtagtcagaaaagggatgaaggatttggaacaaggaaagattcaagttcagaagaagtgataaagcttggtggttcctcttggaggtga

SEQ ID NO: 81 - protein, 385 aa, Arabidopsis thaliana
MAEIQSNGRAYESLLEKVLSMNILSSDYFKELYGLKTYHEVIDEIYNQVNHVEPWMGGNCRGPSTAYCLLYKFFTMKLTVKQMHGLLKHTDSPYIRAVGFLYLRYVADAKTLWTWYEPYIKDDEEFSPGSNGRMTTMGVYYYFDTLFPRIPVPVMRQIVSNLEKMNLPTKPSGSTGDMTRGSEDTARRPPSVKASLSVSFGQRAPHRASTRGSSPVRRPPPTGYDRNGGDEVQQRSPRRSQSRDYYSDRDSDRQREREREKDRERERGRDRYRERERDYGNDRRSRRDYDSRSRRNDYEDDRSRHDRRSRSRSRSRSRSVQIEREPTPKRDSSNKEKSAVTVNSNLAKLKDLYGDASSQKRDEGFGTRKDSSSEEVIKLGGSSWR

SEQ ID NO: 82 - DNA, 680 bp, Arabidopsis thaliana
caaaccttgagaagatgaatttaccaactaaaccttctggttcaaccggagacatgacccgtggctcagaagacactgcccgtcgtccaccatcagtaaaagcatctctctctgtttcatttggtcagcgtgcacctcatcgtgcttccaccagaggctcttctcctgttcgccgtcctccaccgactggttatgacagaaatggaggcgatgaagtacaacagcggtccccacgtagaagccagagccgagactattattctgacagagactcagatagacaacgggaaagagagagggagaaagaccgcgaaagagagagggggagggatagatacagagaaagggagagggattatggtaatgataggagatcaaggcgcgactatgatagtagaagcaggcgcaatgattatgaggacgacagaagtagacatgaccggagaagcaggagcagaagcagaagtaggagcaggagtgtgcagattgagcgtgaaccgactcctaaaagagatagtagcaacaaagagaaatcggcggtgacagtgaacagcaatctcgcaaagctaaaagatttgtatggagacgcaagtagtcagaaaagggatgaaggatttggaacaaggaaagattcaagttcagaagaagtgataaagcttggtggttcctcttggaggtga

SEQ ID NO: 83 - protein, 225 aa, Arabidopsis thaliana
NLEKMNLPTKPSGSTGDMTRGSEDTARRPPSVKASLSVSFGQRAPHRASTRGSSPVRRPPPTGYDRNGGDEVQQRSPRRSQSRDYYSDRDSDRQREREREKDRERERGRDRYRERERDYGNDRRSRRDYDSRSRRNDYEDDRSRHDRRSRSRSRSRSRSVQIEREPTPKRDSSNKEKSAVTVNSNLAKLKDLYGDASSQKRDEGFGTRKDSSSEEVIKLGGSSWR

SEQ ID NO: 84 - DNA, 1068 bp, Arabidopsis thaliana
atggcaaacagaacagatccgttggcaaagaatataagaggaacgaatccgcagaatctggtagagaagattgtgcgaacgaagatttatcagcacaccttttggaaggagcagtgctttggtctcacggcggagacattggtggacaaagctatggagctcgaccatctaggtggtacctttggtggtagccgcaagcctactccgttcctttgcctcatattgaagatgcttcaaatccagcctgagaaggaaattgtcgtggagttcataaaaaatgatgactacaaatatgttcgtattcttggtgcgttctatctgcgtctcactgggactgatgttgatgtctatcgctacctcgaacctctctacaatgactaccggaaagtgagacaaaagttatctgatgggaagttttcgctgacacatgtggacgaagtcattgaggaacttctaaccaaggattattcttgtgatattgcaatgccacgtttgaagaaaaggtggacgcttgaacagaatggtttattagagccaaggaaaagtgttttggaagacgactttgaagaagaggaagaaaaggaggagaatgaagggattgctgatggatctgaagatgagatggatcagcgccgtaagagtcctgaaagagaaagagaaagagacagagacaggagacgcgacagtcatagacacagggatcgtgattatgacagagactatgatatggatcgagatcatgacagagactatgaaagagaacgtgggcatggtcgagaccgggatagggagagagacagggatcactatagagagcgagatagggacagggaaagaggcagagatagagaacgagacagaagagacagggcaaggcgcagaagtagaagcaggagtagggatcgtaagagacatgaaactgatgatgtgcgggatcgggaagaacctaagaaaaagaaagaaaagaaggagaagatgaaggaagatggaaccgatcatccaaatcctgaaattgcagagatgaatagactgagagcatcactgggaatgaaacccctcagggactga

SEQ ID NO: 85 - protein, 355 aa, Arabidopsis thaliana
MANRTDPLAKNIRGTNPQNLVEKIVRTKIYQHTFWKEQCFGLTAETLVDKAMELDHLGGTFGGSRKPTPFLCLILKMLQIQPEKEIVVEFIKNDDYKYVRILGAFYLRLTGTDVDVYRYLEPLYNDYRKVRQKLSDGKFSLTHVDEVIEELLTKDYSCDIAMPRLKKRWTLEQNGLLEPRKSVLEDDFEEEEEKEENEGIADGSEDEMDQRRKSPERERERDRDRRRDSHRHRDRDYDRDYDMDRDHDRDYERERGHGRDRDRERDRDHYRERDRDRERGRDRERDRRDRARRRSRSRSRDRKRHETDDVRDREEPKKKKEKKEKMKEDGTDHPNPEIAEMNRLRASLGMKPLRD

SEQ ID NO: 86 - DNA, 1185 bp, Brachypodium sylvaticum
atggagatacagtcgtccgggaggcccatcgaggtgctcatggagaaggtgctgtccatgaacatcgtctcctcggactacttcaaggagctctacaagatcaagacgtaccacgaggtcatcgacgagatctacaaccaggtcgaccacgtcgagccgtggatgaccggcaactgccgcggcccatccaccgccttctgcctcctctacaagctcttcaccatgaagctcaccatgaaccagatgcacggcctgctcaagcaccctgattccccttacatcagagctattggatttctctacctacgatacgttgcggaaccaaagacgctatggacttggtatgagccctacattaaagatgatgaggagttttcccctgggtcgaatggtaaaatgacaactatgggcgtttatgtgcgtgatgtcctccttggccagtactacttcgacagtcttcttccgcgagtgcctctcctaattttgcgacaggtcagtgcccatcttgagaagatgaagctcccaacaaagcagtcagggatgactggggattcaagtcgccttggttcagatgatactgcccggcgtcctccttcggtgaaggcctctttgtctgtctcttttggtcagcgtgcgccacaccgtgcgtccacaagggactcgtctccagttcgaaagacattgccttctatacgggaaagggaaaggagtcatgacggtgatcgtgcaaaatctccacccaggaagcgccgaagtgaaagtcgggagcgtaatcgtgaaactgagagggaccgttcggatcgtgatcgtggtagatataacgatagagaacaaggtcggcaaagccgtgacagcagagatcgtgattaccatcgttcgagctatgcagaaagagatgttgaaagacgaggccatgaaaggagggacaggaactctgatcgaaatggacgttcgagcgcccacagaagcaggagtaggagcaggagtccaagccgtggcagaaccaacggggaccaccgtcgctctagcccatttggtaaagcacccgagtcatccaacttggctaagttgaaggatctttacggcgatgcgtcaaatgcaaaggaagatgcaggcgatggtagagctcgcagggattccggagctgaagaggtaatcagattgggaggtgcaaggtggaggtga

SEQ ID NO: 87 - protein, 394 aa, Brachypodium sylvaticum
MEIQSSGRPIEVLMEKVLSMNIVSSDYFKELYKIKTYHEVIDEIYNQVDHVEPWMTGNCRGPSTAFCLLYKLFTMKLTMNQMHGLLKHPDSPYIRAIGFLYLRYVAEPKTLWTWYEPYIKDDEEFSPGSNGKMTTMGVYVRDVLLGQYYFDSLLPRVPLLILRQVSAHLEKMKLPTKQSGMTGDSSRLGSDDTARRPPSVKASLSVSFGQRAPHRASTRDSSPVRKTLPSIRERERSHDGDRAKSPPRKRRSESRERNRETERDRSDRDRGRYNDREQGRQSRDSRDRDYHRSSYAERDVERRGHERRDRNSDRNGRSSAHRSRSRSRSPSRGRTNGDHRRSSPFGKAPESSNLAKLKDLYGDASNAKEDAGDGRARRDSGAEEVIRLGGARWR

SEQ ID NO: 88 - DNA, 489 bp, Brachypodium sylvaticum
atggagatacagtcgtccgggaggcccatcgaggtgctcatggagaaggtgctgtccatgaacatcgtctcctcggactacttcaaggagctctacaagatcaagacgtaccacgaggtcatcgacgagatctacaaccaggtcgaccacgtcgagccgtggatgaccggcaactgccgcggcccatccaccgccttctgcctcctctacaagctcttcaccatgaagctcaccatgaaccagatgcacggcctgctcaagcaccctgattccccttacatcagagctattggatttctctacctacgatacgttgcggaaccaaagacgctatggacttggtatgagccctacattaaagatgatgaggagttttcccctgggtcgaatggtaaaatgacaactatgggcgtttatgtgcgtgatgtcctccttggccaggtatatctcttaaagtatgctcccacttcttccattaaacatatttga

SEQ ID NO: 89 - protein, 162 aa, Brachypodium sylvaticum
MEIQSSGRPIEVLMEKVLSMNIVSSDYFKELYKIKTYHEVIDEIYNQVDHVEPWMTGNCRGPSTAFCLLYKLFTMKLTMNQMHGLLKHPDSPYIRAIGFLYLRYVAEPKTLWTWYEPYIKDDEEFSPGSNGKMTTMGVYVRDVLLGQVYLLKYAPTSSIKHI

SEQ ID NO: 90 - DNA, 1116 bp, Chlamydomonas reinhardtii
atggaaatccatggctccaacaccaccttcaacctcgagaacgtgctgcgtcaaaacatcctgagctcggactactacaaggggacctgctcggaactgagcaactgttcagacattgtggacgaaatctacgagtctgtcgatcatgtggaaccttggatgagcggcaacgcgcgcgggccttccacggccttctgccttctgcaccgcctcttcacgctcaagctctcagcaaaggaggtgaaaggcatgctggaccacaaggactctccctacatccgcgcagtgggcttcctgtacctgcgctacgtgggggacccgaagacgctgtggagctgggtggcgccgtacgtgaaggatcaggagaaattttcgccgagcgggccgaacgagaaggaggtggccatgggcgactacgtacgtgacctgctgctctcccagtactacttcgagaccatcttcccgcgcatcccgaagcccgtgcaagaccaaatcaacgacgagctgacgaagcgcagcctggccacgacggccaagggcaatggcggcgccggcggcgctgaccgccgcggcatggacgactccggcaaccgtcgacccgcctcggtgaaggcgtcgctgtcggtcgcgttcggccagcgcgcgcccaaccgctccggtgctcgcgaggagggtcgcggccgggacccatcgcttgcgcagcgcgacggcactgcagcggctcgcggcggccgcggctccgcctcgccggagccgccacgcgaccggcgggaggcgccggcaccgcggcgggatttcgaccgggagcgggacgtgcgcggaggcggtggtggcggcgctgaccgccgtgacaaccgggactacggccgcgaccgggaccgtggtcgcgactacgacaagagccgggattatgacaagagccgggattacgccaagggcagggactatgaccgggggcgggactacgggcgcggcggtggcgctggtggtggcggccgcggctacgatgaccgccgggacgaacggcggcgcagccggagccggagccgcagccgggaccgcaacggcggcggtgctcgggacgcgcgcgatgtattcaaggacgcccggcggtag

SEQ ID NO: 91 - protein, 371 aa, Chlamydomonas reinhardtii
MEIHGSNTTFNLENVLRQNILSSDYYKGTCSELSNCSDIVDEIYESVDHVEPWMSGNARGPSTAFCLLHRLFTLKLSAKEVKGMLDHKDSPYIRAVGFLYLRYVGDPKTLWSWVAPYVKDQEKFSPSGPNEKEVAMGDYVRDLLLSQYYFETIFPRIPKPVQDQINDELTKRSLATTAKGNGGAGGADRRGMDDSGNRRPASVKASLSVAFGQRAPNRSGAREEGRGRDPSLAQRDGTAAARGGRGSASPEPPRDRREAPAPRRDFDRERDVRGGGGGGADRRDNRDYGRDRDRGRDYDKSRDYDKSRDYAKGRDYDRGRDYGRGGGAGGGGRGYDDRRDERRRSRSRSRSRDRNGGGARDARDVFKDARR

SEQ ID NO: 92 - DNA, 1676 bp, Hordeum vulgare
attcggcacgaggcctcccctttcctcgcctccttcatccatactccggcgatctcccagctaccgtcgaatcccaaacatcacaccctccgccgtcgccgaagccgatacgagttcatcctctacagagagtcgtcatcccctctggtttgggggtctccgcaagccgccctcgctctcggaagccaaggaggtcgtagggtttgcgcgcatcctccgtgtttgtgttcgctgaaatatggagatacagacttcaggaaagcccatcgatatgttgatggagaaggttctttgtatgaatattctttcttctgattacttcaaggagctctacaggatgaagacctatcatgaggtcattgacgagatctataaccaagttgatcatgtggagccttggatgactggcaattgcaggggtccttccactgcattttgtctcctgtacaagttcttcacaatgaagcttactgtgaaacagatgcatggtttgttgaagcatcctgactccccgtacattagagctataggatttttgtatcttcgatatgttgcagatccaaagatcctatggacatggtatgagccctacttgaaggatgatgaggaattctcccctggatctaatggtcgcatgacaaccatgggtgtatttgtgcgtgatcttatacttggacagtactactttgatagtatccttccaagagttcctgttccagtagttcgtcaagtaacagccaatcttgagaagatgaagctgcctaccaagctttctggggtgactggagacagtcgccacggatcagaggatactgcccgtcgccccccttctgttaaagcttctttgtcagtttcttttggacagcgtgcgccacaccgtgcttccacacgggattcttccccagtgcgacgaacagtcacccaagatgatcaacggagatcatcttccccatttcgtcgtagtgcaagtcgggaggggccttacagtgaccgttcaattcacgaccgagaaggtaaccgttcaagccgtgaccgagatactgaccattcaagccgtgaccgagatactgtccgttcaagccgtgaccgagatactggccgttcaagccgtgaccgagatactggcctttcaagccgtgacagagagcgtgattatgaccgtgacagcagggattgtgactattacaggttcaggcattcagaagaaaaaaggaattaccgaagcgaacatgacaatagtagacacagacgctccagctcatgtcataggagcagaagccggagtcggagcaggagcaggagcaggaatgagcatcgttccagtccatttggggatacaagcaaagagaaggctgctgctgcctcgagcaacctagctaagctgaaagacctgtacggcgacgtagctgagaagaaggatgatggtgatgccaggcggcttcaccatgattcatgtgccgaagaggttattaggttgggaggccctaggtggagataaatatgaaccgccgactctgtcatccaggtcatgctgttactgcaccgttcgatttacctgcttttgcattgacattagtgagatcactctttgtaaacactcggtactttatgtggttcattaatccatatcttttggacgtgcagtcaatctatcaaattcatcaacgtaaaaaaag

SEQ ID NO: 93 - protein, 365 aa, Hordeum vulgare
MEIQTSGKPIDMLMEKVLCMNILSSDYFKELYRMKTYHEVIDEIYNQVDHVEPWMTGNCRGPSTAFCLLYKFFTMKLTVKQMHGLLKHPDSPYIRAIGFLYLRYVADPKILWTWYEPYLKDDEEFSPGSNGRMTTMGVFVRDLILGQYYFDSILPRVPVPVVRQVTANLEKMKLPTKLSGVTGDSRHGSEDTARRPPSVKASLSVSFGQRAPHRASTRDSSPVRRTVTQDDQRRSSSPFRRSASREGPYSDRSIHDREGNRSSRDRDTDHSSRDRDTVRSSRDRDTGRSSRDRDTGLSSRDRERDYDRDSRDCDYYRFRHSEEKRNYRSEHDNSRHRRSSSCHRSRSRSRSRSRSRNEHRSSPFG

SEQ ID NO: 94 - DNA, 1824 bp, Lycopersicum esculentum
gagcttttgtatcccctcgatctccggttcctctctccttcttcttctcttcgtcgtcaattttccattttccctcatcgattctccggcggaaaaccgaaaaaaggtaattcataatctgaacctaaaccttttccgatatcatttttattgttggccacagaaggtaggaaaagataacactctggtgtccaagtcactaagggcatggctgagcttaagacttctgggagacctatagaccagttgttggagaaggttctctgcatgaacattctatcttctgattacttcagagaccttttgcgcctgaaaacttatcatgaagtgattgatgaaatctataatcaagttgaccatgtggaaccatggatgactggcaactgtcgtggtccttcaacagccttctgccttctctacaagttcttcacaatgaaacttactgtcaagcaaatgcatggcctgttaaagcatccagattctccttacattagagctattgggttcctttatctgagatatcttggtgattttaagacattatggggttggtatgagccttacctcaaagatgatgaggaattctctcctggatccagtgggcaaatgaccacaatgggtgtatatgtgcgtgacttatttctcgggcagtattattttgacacactactaccccgcattcctgttcctgtcgtgcggacagcagttgccagtctcgaaaaaatgaatctgccgaccaaactttctgggtcgattggggattctagtcgtggatctgaggaaacttctcgccggccaccttctgtcaaagcttccctttcagtgtcctttggtcagcgggcacctcatcgtgcatcaactagagattcatctcccatccgaagaacaattgcaccaccatcctatgataaggatggtgcaaatggttcaagacgttcccccagcatgcgccggagtcaaagccgtgatttatctgaccgggaaaattctgaaagggacaggggccgggaccgggacagggacagggacagggacagggacagggacagggaaagaactagggacagagaacgtgatagggatagggatagggataggtatagggaccaggaaagagaaagggataggggcagggatcgggatagagatagaaggtatgataacgaaagagatcgtgaaagggacagagacaggaggcatgattatgacagagaccggggaagggatagagacaggaggtatgactatgatcgaaggtcaattgagagaagcagaagagactatgacaggagcaggagccgtagtaggagtagaagccacagccgaagcttgcatgatcaaggtacaaggcttgaccagcagcgaactccacctagggatgagagcaaggagaagaaggctgcatctagcaatctggccaagcttaaagatctatatggcgacttcggcaataaaaaggagaacataggtgatgacagggctccaaatagggatactagtactgaggaggttatcagacttggtggttctacatggaggtagttggttacatttacgttttgtaagagtttggatactctcactgtctcaccttctcagaagagcacattgacagctagccttttgttgaaagggaatatgcaaactgatagctgcagagaggagatgctgtttcatgttttctgcagtcggcagagctgcttgtaaactggatttcctttactattattttagacttgtgttacaatattggatggatttcaattgtccctttgtttgttaaaacattattactacttaaagcaattgacaaacttataagcc

SEQ ID NO: 95 - protein, 444 aa, Lycopersicum esculentum
MAELKTSGRPIDQLLEKVLCMNILSSDYFRDLLRLKTYHEVIDEIYNQVDHVEPWMTGNCRGPSTAFCLLYKFFTMKLTVKQMHGLLKHPDSPYIRAIGFLYLRYLGDFKTLWGWYEPYLKDDEEFSPGSSGQMTTMGVYVRDLFLGQYYFDTLLPRIPVPVVRTAVASLEKMNLPTKLSGSIGDSSRGSEETSRRPPSVKASLSVSFGQRAPHRASTRDSSPIRRTIAPPSYDKDGANGSRRSPSMRRSQSRDLSDRENSERDRGRDRDRDRDRDRDRDRERTRDRERDRDRDRDRYRDQERERDRGRDRDRDRRYDNERDRERDRDRRHDYDRDRGRDRDRRYDYDRRSIERSRRDYDRSRSRSRSRSHSRSLHDQGTRLDQQRTPPRDESKEKKAASSNLAKLKDLYGDFGNKKENIGDDRAPNRDTSTEEVIRLGGSTWR

SEQ ID NO: 96 - DNA, 1157 bp, Medicago truncatula
atggcaaatcgcactgatccagcagcgaagagtattcgaggcacaaaccctcaaaaccttgttgaaaaaattctccgctcaaagatctatcagcacacttattggaaagaacaatgcttcggcttaacagcagaaaccctagtcgacaaagccatggagctcgaccacctcggcggaacttacggtggcaaccgcaaacccactcccttcatgtgcctcgtcatgaaaatgcttcagattcaacccgagaaagaaatcgtcatcgaattcatcaaaaacgatgattacaagtatgtgaggatactgggtgcattttatttgcgtcttactggatctgatacggatgtgtaccattatctggagccgttgtataatgattataggaaactgcggcggaaattaccggatggacagtttgctttgacacatgttgatgaggttattgatgaacttcttacaactgattattcctgtgatattgctatgccccgtattaagaaaaggtggactcttgaatctcttggtgccttagaacctagacaaagtgcacttgaagaggattttgaggaggaagaggaaaatgaggataatgaacagcctgctgaggagcctgagaaggattataatcgtgggcgaagccctgcaagggaaagagatagggatagaagacgtgatagtcatagacacagggatcgtgactatgacagagaatatgatagagattatgacagagagcgaggacgtggccgagatagagatcgggacagagatagggaaaaggaaagggacagagatagggagagggacagagaccgatatcgtctgagggaagaaaaggattatggtcgtgagagagaaggtagggagcgcgagaggagagacagagatcgtgaccgtggtaggaggaggagctactcaaggagtcgaagtagaagcagggatcgcaaggatcatgatggtggggactacagaaagagacatgctcgaagtagcgtaagtccaagaagagatggagctgaggatggtgagccaaagaagaagaaggaaaagaaagaaaagaaggaaaagaaggatgacgggaccgaccatccagatccagagattgcagaagcaaacaggatacgagcatcactgggtttgaaaccacttaagatgtg

SEQ ID NO: 97 - protein, 385 aa, Medicago truncatula
MANRTDPAAKSIRGTNPQNLVEKILRSKIYQHTYWKEQCFGLTAETLVDKAMELDHLGGTYGGNRKPTPFMCLVMKMLQIQPEKEIVIEFIKNDDYKYVRILGAFYLRLTGSDTDVYHYLEPLYNDYRKLRRKLPDGQFALTHVDEVIDELLTTDYSCDIAMPRIKKRWTLESLGALEPRQSALEEDFEEEEENEDNEQPAEEPEKDYNRGRSPARERDRDRRRDSHRHRDRDYDREYDRDYDRERGRGRDRDRDRDREKERDRDRERDRDRYRLREEKDYGREREGRERERRDRDRDRGRRRSYSRSRSRSRDRKDHDGGDYRKRHARSSVSPRRDGAEDGEPKKKKEKKEKKEKKDDGTDHPDPEIAEANRIRASLGLKPLKM

SEQ ID NO: 98 - DNA, 1305 bp, Oryza sativa
atggagatacaaacttcagggaagcccattgatctgctgatggagaaggttctttgtatgaacattatgtcttctgattacttcaaggagctctacaggctgaagacctatcatgaggtcattgatgaaatatacaatcaagttgatcatgtggagccttggatgactggcaattgcaggggcccctccactgcattctgtctcctctacaagttcttcaccatgaagcttactgtcaaacagatgcatggtttgttgaagcatcctgattccccatacattagagctatagggttcttgtatcttcgatatgttgcagatccgaagatcttgtggacgtggtatgagccctacttgaaggatgatgaggaattctcccctggatctaatggtcgcatgacaaccatgggtgtttatgtgcgtgatcttatacttggacagtactacttcgatagtcttcttccaagagttcctcttccagtaattcgtcaagtgacatccaatcttgagaagatgaagttgcccactaagctttctgggattactggagagtctaatcgtcatggatcagaagatactgcccgccggcctccttccgtgaaggcttctctgtcagtttcctttggacagcgtgctccgcatcgtgcatccacacgggagtcatctccagttcggaggacagtcacccatgatggccatcgtaaatcttcctcaccatctcgccgtagcggaagccgcgaggttcctgatcgtgatcgatcaagccgtgaccgttctagtcgtgactatgaccgttcaagccatgaccgtgatcgtgaccattccagtcgtgactatgaccgtccaagccatgaccgtgaccgtgatcgtgaccgttccagtcgtgactatgaccgttcaagtcgtgaccgggatcatgatagagacatcagagactatcatcggcgtgatcgtgacagcagggaccgtgactataggtctaggcattcatccgaaagacaagatgaccgaagggaccgtgaccgtgagggtagcaggcacagacggtccagctctcggcacagaagcagaagccgcagccgcagccgcagccgcagcagaagcaggagccgcagcagaaatgaggagagatccagtccttttggcaatgcaggcaaagaaaagactgctgccatctcgagcaacctagcaaagctcaaggacttgtatggtgatgtaactgagaagaaggacgacggtgaagcccctcgccgtgattcgtgcgcggaggaggttatcaggttgggtggcccgagatggagatag

SEQ ID NO: 99 - protein, 434 aa, Oryza sativa
MEIQTSGKPIDLLMEKVLCMNIMSSDYFKELYRLKTYHEVIDEIYNQVDHVEPWMTGNCRGPSTAFCLLYKFFTMKLTVKQMHGLLKHPDSPYIRAIGFLYLRYVADPKILWTWYEPYLKDDEEFSPGSNGRMTTMGVYVRDLILGQYYFDSLLPRVPLPVIRQVTSNLEKMKLPTKLSGITGESNRHGSEDTARRPPSVKASLSVSFGQRAPHRASTRESSPVRRTVTHDGHRKSSSPSRRSGSREVPDRDRSSRDRSSRDYDRSSHDRDRDHSSRDYDRPSHDRDRDRDRSSRDYDRSSRDRDHDRDIRDYHRRDRDSRDRDYRSRHSSERQDDRRDRDREGSRHRRSSSRHRSRSRSRSRSRSRSRSRSRNEERSSPFGNAGKEKTAAISSNLAKLKDLYGDVTEKKDDGEAPRRDSCAEEVIRLGGPRWR

SEQ ID NO: 100 - DNA, 1179 bp, Oryza sativa
atggcgaaccgcacggaccccctggcgaagagcatccacgggacgaaccctcagaacctggtggagaagatcgtccggtccaagatctaccagagcacctactggaaggagcagtgctttggcctcaccgccgagaccctcgtcgacaaggccatggagctcgaccacaccggcggcacctacggcggcaaccgcaagcccacccccttcctctgcctcgccctcaagatgctccagatccagcccgacaaggacatcgtcgtcgagttcatcaagaacgaggattacaagtatgtccgtgttcttggtgccttctaccttcgcctcactgccaccgtcgccgacgtctaccaatacctcgagccgctctacaacgactaccgcaagatcaggcacaagctcagtgatggaaagtttaccctgacccacgtcgacgagttcattgacgacctcctcaccaaggactactcctgcgatacggccctcccccgcatccagaaaagatgggttcttgaaacttctggaactctagaaccaagaagaagtgcacttgaagatgattttgaggaagaggaggaagacaaggaggatgaacaacctatggatatagatgagccaaatggtcgtgaaaagcatgatcattatcgtggaaggagccctactagagatcgagacagggagaggaaacatgaaagacaccacagggaccgagattacgacagagatcgggattatggtaggggacgggaaagagaccgagatagagaccgtgaaagagatagagacagggatagagatcgggatcgggatcgggatcgagaccgtcatcgcatacgagatgaggactacagtcgagatagggaccgagcaagagatagggatggcagggaaagagaacgctgggacagagaccgtgggaggcgcaggagccgttcaaggagcaggagcagggatcgacgagaaagagaccgagaagatggagagtaccgtaggaggcgtgatcggggtagtgccagtcctcgaggtcatgcggaggatggtggctcaagagatgagccgaagaagagaaaggaaaagaaagagaagaagggtgaaggaaatgcaccagatccaaatgacccagagattatagaaatgaacaagctccgagcctctctagggttgaaaccactgaagtag

SEQ ID NO: 101 - protein, 392 aa, Oryza sativa
MANRTDPLAKSIHGTNPQNLVEKIVRSKIYQSTYWKEQCFGLTAETLVDKAMELDHTGGTYGGNRKPTPFLCLALKMLQIQPDKDIVVEFIKNEDYKYVRVLGAFYLRLTATVADVYQYLEPLYNDYRKIRHKLSDGKFTLTHVDEFIDDLLTKDYSCDTALPRIQKRWVLETSGTLEPRRSALEDDFEEEEEDKEDEQPMDIDEPNGREKHDHYRGRSPTRDRDRERKHERHHRDRDYDRDRDYGRGRERDRDRDRERDRDRDRDRDRDRDRDRHRIRDEDYSRDRDRARDRDGRERERWDRDRGRRRSRSRSRSRDRRERDREDGEYRRRRDRGSASPRGHAEDGGSRDEPKKRKEKKEKKGEGNAPDPNDPEIIEMNKLRASLGLKPLK

SEQ ID NO: 102 - DNA, 915 bp, Ostreococcus tauri
atgacgtactggaaggagaagtgcttcggcgtgagcgccgaggcgttggtcgatctcgcggtcgacctcaggtcggtgggtgggatttacggcgggaacaacagagcgacggagtttttgtgcctcacgctgaagctgttgcagatacagcctgagaaggagatcgtgttagagtttattaagaatgaggatcacaagtacgtcaggttgctcggcgcgttttacctacggttggtggggaaaccgacggacgtgtacagatacctcgagccgctgttgaacgactatagaaaggttcggtatcgcacgcgtgatgggaagtacgcactgacgcatgtggatgagtttgtgaacaatttgttgacgaaggatatgttttgcgacgtgacgctcccacgcgtgccgcatcgccaggtgttagaggccgcgggagcgcttgagccacgcgtatctgcgcttgaggaggatatcgcagatttggaggaagagctcgagagcgcggtggaggaggcaataggtcaacggatgaacatggatgtcgacgcaggcgaggccgctgccgcggcgtccactcgaggtgcgcgcgaggacggcgagatcgttgcgtcgggatcgaagcgttcgcgcgagcacgatggcgttcggtatcgagaatgtgacgatagcgacggtgacaggtacgtccgaaggcgcgagcggtcgagatctaggagtcgcgaccgcgtgccggcacgccgcgacgacgctcggcccggagttttggctagtggcgaagagatggatcacagagagaagaaggagaagaaagagaagaaggaaaaacgagagaagaaggagaagaccgagatggaccccgaaatcgcagaggcgaatgcgatcagggccaagctcgggttgaagccgcttcgtggatga

SEQ ID NO: 103 - protein, 304 aa, Ostreococcus tauri
MTYWKEKCFGVSAEALVDLAVDLRSVGGIYGGNNRATEFLCLTLKLLQIQPEKEIVLEFIKNEDHKYVRLLGAFYLRLVGKPTDVYRYLEPLLNDYRKVRYRTRDGKYALTHVDEFVNNLLTKDMFCDVTLPRVPHRQVLEAAGALEPRVSALEEDIADLEEELESAVEEAIGQRMNMDVDAGEAAAAASTRGAREDGEIVASGSKRSREHDGVRYRECDDSDGDRYVRRRERSRSRSRDRVPARRDDARPGVLASGEEMDHREKKEKKEKKEKREKKEKTEMDPEIAEANAIRAKLGLKPLRG

SEQ ID NO: 104 - DNA, 630 bp, Ostreococcus tauri
atgccgtcggtgatcgaaaaccacggacgaccgatctggaccccgttcgggaacggcgcggcgacgagcgggaagtcgcacggcgtcgaggaggtgcttcgacaaaacattgcgcactcagaatactttcgaaaacttcgtcgcgcggacgatctggggcgaccggcgtacgatttcatggcgctcgtggatgagatttatgaattggtcgatcactgcgaaccgtggatgtgcgggaacgcgcggggggcgtcgacggggttttgcatcttgtttcaattctgtgagatggagctcagcgacggcaacgtgtggcatttgttgaggcacggagactcgccgtttatccgagctttagggttcctgtatgtacggtacgtgaagaacgggcgggagctcttgaagtggtgcgaggagttcttcggagacgaggaaaagtttaaaccgtcgccggacgggaaggaggtgacgatgggcgcgttcgttcgcgacttgctgctcgagcagaggtacttcgaaaccatcctgccgaggattcctgaggttgcgaggagagagatcataaaggtctcggttgcggtggtcagggcgggagccgcattgctggtggttctcagccgcagtctgtga

SEQ ID NO: 105 - protein, 209 aa, Ostreococcus tauri
MPSVIENHGRPIWTPFGNGAATSGKSHGVEEVLRQNIAHSEYFRKLRRADDLGRPAYDFMALVDEIYELVDHCEPWMCGNARGASTGFCILFQFCEMELSDGNVWHLLRHGDSPFIRALGFLYVRYVKNGRELLKWCEEFFGDEEKFKPSPDGKEVTMGAFVRDLLLEQRYFETILPRIPEVARREIIKVSVAVVRAGAALLVVLSRSL

SEQ ID NO: 106 - DNA, 1409 bp, Populus trichocarpa
ctcaggagtgcttggattgtttagtacagtatggagatacagacaaatgggaaaccaatagattcgctgttagagaaggtcctttgtatgaacatactatcatcagattacttcaaggagctttaccgattaaagacataccatgaagtgatagatgaaatatacaatcaagttgaccatgttgagccatggatgactggcaactgtcgtggtccatctacttccttttgccttctatacaagttcttcaccatgaaactcactgtcaaacaaatgcatggtttgctaaagcacaaggattctccttatatcagagcggttgggttcctctacctgagatatgctggggatccaaagacactgtggaattggtttgaaccatatattaaagacgatgaggaattttctccaggaactagtggaaggaagacgacaatgggtgtttatgtgcgtgatttgcttctcggacagtactactttgatacccttttcccccgtattcctgttcctgtcatgcggcagatcacatcgaatctggagaagttgaagctaccaacaaaaatctctggttcgacaggggatggaaaccgtcatggatctgatgatacggcacgccggccaccatctgtgaaggcagcactttcagtctcttttggtcagcgtgctcctcatcgtgcatcaaccagggattcgtctcctgttcgtcgcacaataccttccccctcctatgacagaaccagtgatgattcacgaagtcgactcggccagagtcgtgaatattctgataaagaatattcagatcgggatcatgataggggtagggaaagggaccaagaccatgatcgggatagagagagggacagggttcgggatagggatcaggagagagaaagggaccgggatcgtgaaagggattgggatcagagtcgggacagagacagggatcgggaaagggatagatacagaaggtatgattatgatagaagttccaggtacactgatagggaaagcagaagggattctgaacagagcagccgtgacagaagtaggcattatagagaaagtagttcttatagaagccgcagtcgaagcaggagcaggagcaggagccgaagctcgcaagctggcgcatcaccatttgatcgccatccaactcctcaaagggatggaaacaaggataagacatctgcgcctagcaatctggctaagctcaaagatctttatggtgatcttagtgatcagaaaggggatgctggcctggaaagggttcctcggagggataatgatggtgaagaggtttttagactcggtggttccacttggaggtaggtagttcaatcttaaaacagtagcttcagtggctgtcacatcagctgtatcaatgaggtcttcagccaggccaaatttct

SEQ ID NO: 107 - protein, 432 aa, Populus trichocarpa
MEIQTNGKPIDSLLEKVLCMNILSSDYFKELYRLKTYHEVIDEIYNQVDHVEPWMTGNCRGPSTSFCLLYKFFTMKLTVKQMHGLLKHKDSPYIRAVGFLYLRYAGDPKTLWNWFEPYIKDDEEFSPGTSGRKTTMGVYVRDLLLGQYYFDTLFPRIPVPVMRQITSNLEKLKLPTKISGSTGDGNRHGSDDTARRPPSVKAALSVSFGQRAPHRASTRDSSPVRRTIPSPSYDRTSDDSRSRLGQSREYSDKEYSDRDHDRGRERDQDHDRDRERDRVRDRDQERERDRDRERDWDQSRDRDRDRERDRYRRYDYDRSSRYTDRESRRDSEQSSRDRSRHYRESSSYRSRSRSRSRSRSRSSQAGASPFDRHPTPQRDGNKDKTSAPSNLAKLKDLYGDLSDQKGDAGLERVPRRDNDGEEVFRLGGSTWR

SEQ ID NO: 108 - DNA, 1394 bp, Populus trichocarpa
acaggagtgcttgcatttgtttagtacattatggaggtacagacaaatgggaaaccgatagattcactctttgagaaggtcctttgtatgaacattctatcatcggattacttcaaggagctttaccgattaaagacgtaccatgaagtgattgatgaaatatacaatcaagttgacaatgttgagccatggatgactggtaactgtcgtggcccatctacgtccttttgccttctgtacaagttcttcaccatgaagctcactgtcaaacaaatgcatggtctgctaaagcacaaggattctccttatatcagagcggttgggttcctttacctgagatatgctggtgacccaaagacactgtggaattggtttgaaccatatatcaaagatgatgaggaattttctcctggatctagtggaaggaagacaacaataggcatatatgtgcgtgatttacttctcggacagtactactttgatacccttttcccccgtattcctgttcctgtcttgcggcagatcacagccaatcttgagatgatgaagctacccacaaaaatttctggttcaacaggggatggcaaccgtcatggatctgatgatactgcacgtcgaccaccatctgtgaaggctgcactttcagtctcttttggtcagcgtgctcctcatcgtgcatcaactagggactcatctcctgttcgtcgcacgctaccgccaccctcctatgacagaaccagtgatgatccacgaagtcatcgcagccagagtcgcgaatattctgataaagaatattcagacagggatcgggatcaagataggggtagagagagggaccgtgatagggacagagagagggacagggttcgggatagagatcatgatagagaaagagatcgggaccgtggcagggacagtgacaggaaacaggaacgtgagaggggtagagaccgaaggtctgattacgataggagttccaggtacactgacagggagagcagaagggattatgaacggagcagccgtgatggaagtaggcgtcatagagaaagtaattatagaacccggagtcggagcaggagcagaagtagaagccaaagcttgcaagctggcacatcaccatttgatcagcatccaactcctcaaagggatggaagcaaggataggacatctgcatctagcaatctggctaagctcaaagatctttatggtgatcttggtgatcagaaaggggatgctggcctggaaaggggtcctcggagggacaatgatggtgaagaagtttttagactgggtggttctacttggaggtaggtagttcaatgaaagctgtaactgtctgatgtatcagtaaggtcttcagccatgccaaatcactgtttgagtcaagaaaa

SEQ ID NO: 109 - protein, 427 aa, Populus trichocarpa
MEVQTNGKPIDSLFEKVLCMNILSSDYFKELYRLKTYHEVIDEIYNQVDNVEPWMTGNCRGPSTSFCLLYKFFTMKLTVKQMHGLLKHKDSPYIRAVGFLYLRYAGDPKTLWNWFEPYIKDDEEFSPGSSGRKTTIGIYVRDLLLGQYYFDTLFPRIPVPVLRQITANLEMMKLPTKISGSTGDGNRHGSDDTARRPPSVKAALSVSFGQRAPHRASTRDSSPVRRTLPPPSYDRTSDDPRSHRSQSREYSDKEYSDRDRDQDRGRERDRDRDRERDRVRDRDHDRERDRDRGRDSDRKQERERGRDRRSDYDRSSRYTDRESRRDYERSSRDGSRRHRESNYRTRSRSRSRSRSQSLQAGTSPFDQHPTPQRDGSKDRTSASSNLAKLKDLYGDLGDQKGDAGLERGPRRDNDGEEVFRLGGSTWR

SEQ ID NO: 110 - DNA, 1281 bp, Saccharum officinarum
  misc_feature (1140)..(1141): n is a, c, g, or t
  misc_feature (1220)..(1220): n is a, c, g, or t
cgggctcctttcctccgcctctcgtctagtccctctcctaccgaaccctcccaatccaaagcgattcctccgggccgccgccgtcccgatcgcgccgcgccgccggggcggcgtctccccggctgcccttagctcagctcgcgttccggtggaacagagaagagaggtggggggaatggagatccagtcgtctggccggcccatcgaggggctgatggagaaggtgctgtccgtgaacatcctctcctcggactacttcaaggagctcttcaagtacaagacctaccacgaggtggtcgacgagatctacaaccaggtggaccacgtcgagccctggatgaccggcaactgccgcgggccctcctccgccttctgcctcctctacaagttcttcaccatgaagctcaccgtcaagcagatgcacgggctgctcaagcaccaggactccccctacatcagagctattggattcctctacctgcgatatgttgcagaaccgaagacgctgtggacttggtatgaaccctatatcaaggatgacgaggagtttgcccctggatcaaatggtaaaatgactacaatgggcgtttatgtgcgtgatctcctccttggtcagtactatttcgacagtcttcttccacgagtgcctctcccaattctccgacaggtcactagccatcttgagaagctgaagcttccaacaaagcagtcaggaatgactggggattccaataggcttgaatcaaatgatactgccagaaggcctccttccgtaaaggcttctttgtctgtctcttttggtcagcgtgctccacaccgtgcatacacaagggattcttccccagtccgaagaacattaccttccaaacaggacaaggaaagaagttatgatggtgaccatgcaaaatcgccaccaaggaagcgcagaagtcagagctctgagcgccatcatgactcagagagggaccgttcaaatcgtgatcgtggcaagtacaaggatagggagcatgatcgttatgctcgtgatcacagagaccgggatcatcatcggcagagttattcagatagggatgacgaaaggcgaggccgtgaaaagagggacagggattctgaccgaaagagatattcaagctcccgcanngagcaggagtccagtccgtggcagaactgacggcgacaaacatcgctccagcccaatttgtagggcaccagaatcattncacctggcaaagctaaaggatttatacggtgatgcaacaaacacaaagaatgatgcttgcg

SEQ ID NO: 111 - protein, 331 aa, Saccharum officinarum
  misc_feature (322)..(322): Xaa can be any naturally occurring amino acid
MEIQSSGRPIEGLMEKVLSVNILSSDYFKELFKYKTYHEVVDEIYNQVDHVEPWMTGNCRGPSSAFCLLYKFFTMKLTVKQMHGLLKHQDSPYIRAIGFLYLRYVAEPKTLWTWYEPYIKDDEEFAPGSNGKMTTMGVYVRDLLLGQYYFDSLLPRVPLPILRQVTSHLEKLKLPTKQSGMTGDSNRLESNDTARRPPSVKASLSVSFGQRAPHRAYTRDSSPVRRTLPSKQDKERSYDGDHAKSPPRKRRSQSSERHHDSERDRSNRDRGKYKDREHDRYARDHRDRDHHRQSYSDRDDERRGREKRDRDSDRKRYSSSRXEQESSPWQN

SEQ ID NO: 112 - DNA, 1179 bp, Saccharum officinarum
atggagatccagtcatctgcccggcccatcgaggggctgatggagaaggtgctgtccgtgaacatcctctcctcggactacttcaaggagctcttcaagtacaagacctaccacgaggtggtcgacgagatctacaaccaggtggaccacgtcgagccctggatgaccggcaactgccgcgggccctcctccgccttctgcctcctctacaagttcttcaccatgaagctcaccgtcaagcagatgcacgggctgctcaagcatcaggactccccctacatcagagctattggattcctctacctgcgatatgttgcagaaccgaagacgctgtggacttggtatgaaccctatatcaaggatgacgaggagtttgcccctggatcaaatggtaaattgactacaatgggcgtttatgtgcgtgatctcctccttggtcagtactatttcgacagtcttcttccacgagtgcctctcccaattctccgacaggtcactagccatcttgagaagctgaagcttccaacaaagcagtcaggaatgactggggattccaataggcttgaatcaaatgatactgccagaaggcctccttccgtaaaggcttctttgtctgtctcttttggtcagcgtgctccacaccgtgcatccacaagggattcttccccagtccgaagaacattaccttccaaacaggacaaagaaagaagttatgatggtgaccatgcaaaatcgccaccaaggaagcgcagaagtcagagctctgagcgtcatcatgactctgagagggaccgttcagatcgtgatcgtggcaggtacaagggtagggagcatgatcgttatgctcgtgatcacagagaccgggatcatcatcggcagagttattcagatagggatgacgaaaggcgaggccgtgaaaagagggacagggattctgaccacaatagacattcaagctcccgcaggagcaggagcaggagtccagtccgtggcagaactgacggtgacaagcatcgctccagcccatttggtagggcaccagaatcatccaacctggcaaagctaaaggatttatacggtgatgcaacaaacacaaagaatgatgctggcgatgatagagctcacagggattctggaacggaagaggtaatccgactgggaggggcaaggtggaggtga

SEQ ID NO: 113 - protein, 392 aa, Saccharum officinarum
MEIQSSARPIEGLMEKVLSVNILSSDYFKELFKYKTYHEVVDEIYNQVDHVEPWMTGNCRGPSSAFCLLYKFFTMKLTVKQMHGLLKHQDSPYIRAIGFLYLRYVAEPKTLWTWYEPYIKDDEEFAPGSNGKLTTMGVYVRDLLLGQYYFDSLLPRVPLPILRQVTSHLEKLKLPTKQSGMTGDSNRLESNDTARRPPSVKASLSVSFGQRAPHRASTRDSSPVRRTLPSKQDKERSYDGDHAKSPPRKRRSQSSERHHDSERDRSDRDRGRYKGREHDRYARDHRDRDHHRQSYSDRDDERRGREKRDRDSDHNRHSSSRRSRSRSPVRGRTDGDKHRSSPFGRAPESSNLAKLKDLYGDATNTKNDAGDDRAHRDSGTEEVIRLGGARWR

SEQ ID NO: 114 - DNA, 729 bp, Saccharomyces cerevisiae
atggctgtcaatgaatttcaagtggagtctaacatctctccaaaacaactgaataaccagtcagtgtcacttgttattcctcggttgacaagagataaaattcataattcaatgtactataaagtaaatctaagcaacgaatctttgagaggcaatacaatggtagagcttttgaaagttatgattggcgcatttggtaccataaaaggtcaaaatggtcatttacacatgatggttctcggtggcattgagtttaaatgcatcttaatgaagttaatcgaaatcagaccgaatttccagcagttgaacttcttattgaatgtaaaaaatgagaacggttttgactcgaaatatattattgctttgcttctggtttatgcgcggttacagtattattatttgaatggcaataacaaaaacgatgatgatgaaaatgatttgataaagttatttaaagtacaattatacaaatattcacagcattatttcaaactaaaaagtttcccactacaagtagactgctttgctcactcctataacgaagaactttgtataatacacattgatgaattagtcgattggttggccacacaggaccatatctggggtattccattagggaaatgtcaatggaataaaatatacaactctgatgaagagagtagttctagcgaaagcgaaagtaatggtgacagtgaagatgacaacgacaccagcagcgaatcatag

SEQ ID NO: 115 - protein, 242 aa, Saccharomyces cerevisiae
MAVNEFQVESNISPKQLNNQSVSLVIPRLTRDKIHNSMYYKVNLSNESLRGNTMVELLKVMIGAFGTIKGQNGHLHMMVLGGIEFKCILMKLIEIRPNFQQLNFLLNVKNENGFDSKYIIALLLVYARLQYYYLNGNNKNDDDENDLIKLFKVQLYKYSQHYFKLKSFPLQVDCFAHSYNEELCIIHIDELVDWLATQDHIWGIPLGKCQWNKIYNSDEESSSSESESNGDSEDDNDTSSES

SEQ ID NO: 116 - DNA, 1182 bp, Triticum aestivum
atggcgaaccgcacggacccccgggcccggagcatccacggcaccaaccctcagaacctggtggagaagatcgtgcgggccaagatctaccagagcaactactggaaggagcagtgcttcggcctcacggcggagaccctcgtcgacaaggccatggagctcgactacaccggcggcacccacggcggcaaccgcaggccgacccccttcctctgcctcgctctcaagatgctccagatccagcccgacaaggaaatcgtcgtcgagttcatcaaggacgaggactacaagtatgtccgggttcttggggccttctacctgcgcctcactggcaccgtcgccgacgtttaccagtacctcgagccgctctacaacgactaccgcaagattaggcaaaagctcagcgatggaaaattcacgctgacacacgttgacgaattcattgacgagctcctgaccaaggactatagctgcggcactgccctcccccgcattcagaaaagatggatccttgaagcttctggaactctagaacctagaagaagtgcacttgaagacgattttgaggaagaggaggaagataaggaggatggacagcctatggacgtagatgagcctaacactcatgaaaaggaccatcttcgtggaagaagccccaccaaagaacgcgacagggaaagggagagggacagagacaggaaacacgaaaggcatcacagggaccgagatcatgacagagatcgggatcacgacagggactatggaagaggccgggaaagagatcgagacagagatagaggccgtgaaagagatagagagagggatagggaacgagaccgtcaccgcatccgagatgacgactaccaccgagatcgagaccgggatggcagggaaagggaacgccgggacagagaccgtggcaggcacaggagccgctcagggagcagaagccgggatcggcgtgaaagagaccgtgaagtgggagagctccgtaagaggcgtggccgtggtagtgccagtcctcctcgggggcgtgccgaggatggtccgagggaggagcctaagaagagaaaggaaaagaaagagaagaagggcagcgggaacggtccagatcctaatgatccagagattatagagatgaacaagctgcgtgcatcgatagggttgggaccactgaagtag

SEQ ID NO: 117 - protein, 393 aa, Triticum aestivum
MANRTDPRARSIHGTNPQNLVEKIVRAKIYQSNYWKEQCFGLTAETLVDKAMELDYTGGTHGGNRRPTPFLCLALKMLQIQPDKEIVVEFIKDEDYKYVRVLGAFYLRLTGTVADVYQYLEPLYNDYRKIRQKLSDGKFTLTHVDEFIDELLTKDYSCGTALPRIQKRWILEASGTLEPRRSALEDDFEEEEEDKEDGQPMDVDEPNTHEKDHLRGRSPTKERDRERERDRDRKHERHHRDRDHDRDRDHDRDYGRGRERDRDRDRGRERDRERDRERDRHRIRDDDYHRDRDRDGRERERRDRDRGRHRSRSGSRSRDRRERDREVGELRKRRGRGSASPPRGRAEDGPREEPKKRKEKKEKKGSGNGPDPNDPEIIEMNKLRASIGLGPLK

SEQ ID NO: 118 - DNA, 1119 bp, Vitis vinifera
atggcgaaccgtacggacccagcggcgaagagcatacgaggcacgaatccgcaaaacttggtggagaagattctgaggtcgaagatttaccagaacacgtactggaaggagcagtgctttggattgaccgcggagactctggttgacaaggccatggagctcgaccacctcggcggcacctttggtggtaaccgcaagcccacgcccttcatgtgcctcgtcatgaaaatgctccagatccagcccgagaaggacatcgtcgtcgagttcataaaaaacgaagagtacaaatatgtccgaatacttggtgcattttatttgcgtcttacagggatagatactgatgtgtaccaatacctagagcctctatacaatgactatcggaaattgaggagaaaattatctgatggaaattattctttgacacacgttgatgaggttatcgatgaacttctgacaaaagattattcctgtgacgttgccttgccccgtatcaagaaaagatggactcttgaatcccttggtacactggaaccaagaagaagtgctttggaagatgattttgaggaagaggaagaaaaagaagaggatgaccaactcatggatgaattagatgttggggctcatgaaaaggattattatcgtgggcgaagccctgcaagggagagagatagggatagaaagcgtgacagtcacagatatagagatcgagattatgatagggaacgtggaagaggacgagaaagagatcgggaaagggaaagggacagagacagctatagagacagggagagggagagggacagagacagggaccgctatcgtctgagagatgataaagaatatggtcgtgacagggagagggaaagggagagggaaggcagggagagggagaggcgagacagggaccgagccattcaaggagccgaagtaggagcaaggatcaggcatgctcgcagcagcaccaacatgccagaggatggaaccactcgagaagagccaaggaagaagaaagaaaagaaggagaagaaggatgatggcactgaccacccagatccagagattgcagaagcaaacaggttgcgggcatcccttgggcttaaacccttgaaactctaa

SEQ ID NO: 119 - protein, 372 aa, Vitis vinifera
MANRTDPAAKSIRGTNPQNLVEKILRSKIYQNTYWKEQCFGLTAETLVDKAMELDHLGGTFGGNRKPTPFMCLVMKMLQIQPEKDIVVEFIKNEEYKYVRILGAFYLRLTGIDTDVYQYLEPLYNDYRKLRRKLSDGNYSLTHVDEVIDELLTKDYSCDVALPRIKKRWTLESLGTLEPRRSALEDDFEEEEEKEEDDQLMDELDVGAHEKDYYRGRSPARERDRDRKRDSHRYRDRDYDRERGRGRERDRERERDRDSYRDRERERDRDRDRYRLRDDKEYGRDREREREREGRERERRDRDRAIQGAEVGARIRHARSSTNMPEDGTTREEPRKKKEKKEKKDDGTDHPDPEIAEANRLRASLGLKPLKL

SEQ ID NO: 120 - protein, 33 aa, Artificial sequence
  Conserved Motif I of a PRP38 polypeptide
RRPPSVKASLSVSFGQRAPHRASTRDSSPVRRT

SEQ ID NO: 121 - protein, 14 aa, Artificial sequence
  Conserved Motif II of a PRP38 polypeptide
  VARIANT (7)..(7): Xaa can be Ile or Val
SPYIRAXGFLYLRY

SEQ ID NO: 122 - protein, 8 aa, Artificial sequence
  Conserved Motif III of a PRP38 polypeptide
KLKDLYGD

SEQ ID NO: 123 - protein, 6 aa, Artificial sequence
  Conserved Motif IV of a PRP38 polypeptide
  VARIANT (1)..(1): Xaa can be Leu or Asn
  UNSURE (2)..(2): Xaa can be any naturally occurring amino acid
  VARIANT (4)..(4): Xaa can be Lys or Asn
XXEXVL

SEQ ID NO: 124 - protein, 5 aa, Artificial sequence
  Conserved Motif V of a PRP38 polypeptide
LVEKI

SEQ ID NO: 125 - DNA, 55 bp, Artificial sequence
  primer 1
ggggacaagtttgtacaaaaaagcaggcttaaacaatggcggagatacagtcaaa

SEQ ID NO: 126 - DNA, 48 bp, Artificial sequence
  primer 2
ggggaccactttgtacaagaaagctgggttcacctccaagaggaacca

SEQ ID NO: 127 - DNA, 2194 bp, Oryza sativa; identical to SEQ ID NO: 75

SEQ ID NO: 128 - DNA, 1062 bp, Oryza sativa
atgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctag

SEQ ID NO: 129 - protein, 353 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 130 - protein, 16 aa, Artificial sequence
  Conserved Motif 1 of GATA domain
  VARIANT (2)..(2): Xaa can be Ser,  Ala, or Thr
  VARIANT (3)..(3): Xaa can be Asp, Glu, or Asn
  UNSURE (5)..(5): Xaa can be any naturally occurring amino acid, preferably one of Asn, Lys, Gly, His, Asp
  VARIANT (7)..(7): Xaa can be Thr, Ser, or Ala
  VARIANT (8)..(8): Xaa can be Lys or Ser
  VARIANT (11)..(11): Xaa can be Leu or Met
  VARIANT (14)..(14): Xaa can be Ser, Gly, or Asn
CXXCXTXXTPXWRXGP

SEQ ID NO: 131 - protein, 15 aa, Artificial sequence
  Conserved Motif 2 of GATA domain
  UNSURE (13)..(13): Xaa can be any naturally occurring amino acid, preferably one of Gln, His, Asn, Ser, Tyr, Phe
  VARIANT (14)..(14): Xaa can be Arg or Lys
GPKSLCNACGIRXXK

SEQ ID NO: 132 - protein, 9 aa, Artificial sequence
  Conserved Motif 3 of a GATA-like polypeptide
  VARIANT (1)..(1): Xaa can be Ala or Ser
  VARIANT (2)..(2): Xaa can be Ala or Trp
  UNSURE (3)..(3): Xaa can be any naturally occurring amino acid, preferably one of Met, Leu, Val, Ile, Arg
  VARIANT (4)..(4): Xaa can be Leu or Cys
  VARIANT (5)..(5): Xaa can be Leu or Asn
  VARIANT (6)..(6): Xaa can be Met, Leu, or Val
  VARIANT (7)..(7): Xaa can be Thr, Leu, or Ala
  VARIANT (8)..(8): Xaa can be Leu or Asp
  VARIANT (9)..(9): Xaa can be Ser or Arg
XXXXXXXXX

SEQ ID NO: 133 - DNA, 58 bp, Artificial sequence
  primer: prm10133
ggggacaagtttgtacaaaaaagcaggcttaaacaatgtctactatctacatgagcca

SEQ ID NO: 134 - DNA, 50 bp, Artificial sequence
  primer: prm10134
ggggaccactttgtacaagaaagctgggtagctagctagttttgatcagc

SEQ ID NO: 135 - DNA, 2194 bp, Oryza sativa; identical to SEQ ID NO: 75

SEQ ID NO: 136 - DNA, 3308 bp, Artificial sequence
  expression cassette
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttcatttaaatcaactagggatatcacaagtttgtacaaaaaagcaggcttaaacaatgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctag

SEQ ID NO: 137 - DNA, 1044 bp, Oryza sativa
atgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacagttcaatgatcacatgatgatgggcggatcagatgtcttcctcacaccgtctccgttccgaccaaccatccaaagcatcggcagtgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcggcctctccggcgttcttccacggcctccctcgcgacgagatcaccgacgccgccatgctgctcatgaccctatcctgtggcctcgtccacagctag

SEQ ID NO: 138 - protein, 347 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAAASPAFFHGLPRDEITDAAMLLMTLSCGLVHS

SEQ ID NO: 139 - DNA, 1065 bp, Oryza sativa
atgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacgggcggagcggccggtggcgccggcaaagaggcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctag

SEQ ID NO: 140 - protein, 354 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGRSGRWRRQRGVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 141 - DNA, 1128 bp, Oryza sativa
atggagggggagcaccaccatcaccaccaggatcatcaccaaggccacttccaagccttctccctgcagcctaaggatcccccagtcttattcccctttgtgatcagtagaagaagcagcagcagcagccctagcgacagcaccactctaagctatggttcagaccatcacttgacacagcagcagcagcatcagcatcaagccatgcttgagccccaaaatatgattggaggatcatccgctggcatctttgcgacgccgttcccgaccgtcaagagcatccgcgacgacatgatcgagcggtcgcagttcgatccatacgataccgagaagctgcaggcgagctgcgggttagccaaggtcgtcgccggcggcaagtggagcgcggtgccagcggccaagatgaagatcacgaggaagatgggtgagccgtcgtccggtgtcactggcggggctgcgacgacggtggcgccgaagaagccgaggaggaggccggcgcaggcgtacgaggatcacggccatggcggcgccatgggccaagcttttggcgtgattagggtgtgctccgactgcaacaccaccaagactcccttgtggaggagtggcccgtgcggccccaagtcgctttgcaacgcgtgcggcatcaggcagaggaaggcgcggcgggcgatgatggcctccggactaccagcgtcccccaacgccgccggccccaaggcggccgcacatagcggcgccgctgcggtggcggctgcgcagccgaaggtgaagaaggagaagagagccgacgtcgaccggtcgtcgctgccgttcaagaaacggtgcaaggtcgtccaggtcgaggatcatcaaacgctgcccgccgccacaaacgcagccgccgcagctgccatggaggagacggccgagtccgccaccgtcgccccgcccccggcgccgacgacgaggggtggtactctcgtcgacagcatcgggctcagctggagcaagacccatgccgccgccaccgcctcctgcagcttccggccgtcaccggtggctcccggcttcgcggcggcggtgcaggacgagatcactgacgccgccatgctgctcatgacgctgtcctgcgggcttgtccggagctga

SEQ ID NO: 142 - protein, 375 aa, Oryza sativa
MEGEHHHHHQDHHQGHFQAFSLQPKDPPVLFPFVISRRSSSSSPSDSTTLSYGSDHHLTQQQQHQHQAMLEPQNMIGGSSAGIFATPFPTVKSIRDDMIERSQFDPYDTEKLQASCGLAKVVAGGKWSAVPAAKMKITRKMGEPSSGVTGGAATTVAPKKPRRRPAQAYEDHGHGGAMGQAFGVIRVCSDCNTTKTPLWRSGPCGPKSLCNACGIRQRKARRAMMASGLPASPNAAGPKAAAHSGAAAVAAAQPKVKKEKRADVDRSSLPFKKRCKVVQVEDHQTLPAATNAAAAAAMEETAESATVAPPPAPTTRGGTLVDSIGLSWSKTHAAATASCSFRPSPVAPGFAAAVQDEITDAAMLLMTLSCGLVRS

SEQ ID NO: 143 - DNA, 1119 bp, Oryza sativa
atggagggggagcaccaccaggatcatcaccaaggccacttccaagccttctccctgcagcctaaggatcccccagtcttattcccctttgtgatcaatagaagaagcagcagcagcagccctagcgacagcaccactctaagctatggttcagaccatcacttgacacagcagcagcagcatcagcatcaagccatgcttgagccccaacatatgattggaggatcatccgctggcatctttgcgacgccgttcccgaccgtcaagagcatccgcgacgacatgatcgagcggtcgcagttcgatccatacgataccgagaagctgcaggcgagctgcgggttagccaaggtcgtcgccggcggcaagtggagcgcggtgccagcggccaagatgaagatcacgaggaagatgggtgagccgtcgtccggtgtcactggcggggctgcgacgacggtggcgccgaagaagccgaggaggaggctggcgcaggcgtacgaggatcacggccatggcggcgccatgggccaagcttttggcgtgattagggtgtgctccgactgcaacaccaccaagactcccttgtggaggagtggcccgtgcggccccaagtcgctttgcaacgcgtgcggcatcaggcagaggaaggcgcggcgggcgatgatggcctccggactaccagcgtcccccaacgccgccggccccaaggcggccgcacatagcggcgccgctgcggtggcggctgcgcagccgaaggtgaagaaggagaagagagccgacgtcgaccggtcgtcgctgccgttcaagaaacggtgcaaggccgtccaggtcgaggatcatcaaacgctgcccgccgccacaaacgcagccgccgcagctgccatggaggagacggccgagtccgccaccgtcgccccgcccccggcgccgacgacgaggggttgtactctcgtcgacagcatcgggctcagctggagcaagacccatgccgccgccaccgcctcctgcagcttccggccgtcaccggtggctcccggcttcgcggcggcggtgcaggacgagatcactgacgccgccatgctgctcatgacgctgtcctgcgggcttgtccggagctga

SEQ ID NO: 144 - protein, 372 aa, Oryza sativa
MEGEHHQDHHQGHFQAFSLQPKDPPVLFPFVINRRSSSSSPSDSTTLSYGSDHHLTQQQQHQHQAMLEPQHMIGGSSAGIFATPFPTVKSIRDDMIERSQFDPYDTEKLQASCGLAKVVAGGKWSAVPAAKMKITRKMGEPSSGVTGGAATTVAPKKPRRRLAQAYEDHGHGGAMGQAFGVIRVCSDCNTTKTPLWRSGPCGPKSLCNACGIRQRKARRAMMASGLPASPNAAGPKAAAHSGAAAVAAAQPKVKKEKRADVDRSSLPFKKRCKAVQVEDHQTLPAATNAAAAAAMEETAESATVAPPPAPTTRGCTLVDSIGLSWSKTHAAATASCSFRPSPVAPGFAAAVQDEITDAAMLLMTLSCGLVRS

SEQ ID NO: 145 - DNA, 1044 bp, Oryza sativa
atgtctaccatctacatgagtcagctctcagctgctctccctctcatggagggggagcaccaccatcaccaccaggatcatcaccaaggccacttccaagccttctccctgcagcctaaggatcccccagtcttattcccctttgtgatcagtagaagaagcagcagcagcagccctagcgacagcaccactctaagctatggttcagaccatcacttgacacagcagcagcagcatcagcatcaagccatgcttgagccccaaaatatgattggaggatcatccgctggcatctttgcgacgccgttcccgaccgtcaagagcatccgcgacgacatgatcgagcggtcgcagttcgatccatacgataccgagaagctgcaggcgagctgcgggttagccaaggtcgtcgccggcggcaagtggagcgcggtgccagcggccaagatgaagatcacgaggaagatgggtgagccgtcgtccggtgtcactggcggggctgcgacgacggtggcgccgaagaagccgaggaggaggccggcgcaggcgtacgaggatcacggccatggcggcgccatgggccaagcttttggcgtgattagggtgtgctccgactgcaacaccaccaagactcccttgtggaggagtggcccgtgcggccccaagtcgctttgcaacgcgtgcggcatcaggcagaggaaggcgcggcgggcgatgatggcctccggactaccagcgtcccccaacgccgccggccccaaggcggccgcacatagcggcgccacaaacgcagccgccgcagctgccatggaggagacggccgagtccgccaccgtcgccccgcccccggcgccgacgacgaggggtggtactctcgtcgacagcatcgggctcagctggagcaagacccatgccgccgccaccgcctcctgcagcttccggccgtcaccggtggctcccggcttcgcggcggcggtgcaggacgagatcactgacgccgccatgctgctcatgacgctgtcctgcgggcttgtccggagctga

SEQ ID NO: 146 - protein, 347 aa, Oryza sativa
MSTIYMSQLSAALPLMEGEHHHHHQDHHQGHFQAFSLQPKDPPVLFPFVISRRSSSSSPSDSTTLSYGSDHHLTQQQQHQHQAMLEPQNMIGGSSAGIFATPFPTVKSIRDDMIERSQFDPYDTEKLQASCGLAKVVAGGKWSAVPAAKMKITRKMGEPSSGVTGGAATTVAPKKPRRRPAQAYEDHGHGGAMGQAFGVIRVCSDCNTTKTPLWRSGPCGPKSLCNACGIRQRKARRAMMASGLPASPNAAGPKAAAHSGATNAAAAAAMEETAESATVAPPPAPTTRGGTLVDSIGLSWSKTHAAATASCSFRPSPVAPGFAAAVQDEITDAAMLLMTLSCGLVRS

SEQ ID NO: 147 - DNA, 363 bp, Arabidopsis thaliana
atggatccaaggaagctactatcttgttcatcctcttacgtgtcagtgagaatgaaagaagagaaggggacaattaggtgttgcagtgagtgtaagaccaccaagacaccaatgtggagaggtggaccaactggtcctaagtcactttgcaatgcatgtggaattagacacagaaaacagagacgatcagagttattgggtattcatattattcgcagccacaaaagcttagcctccaagaagataaacctattatcatcatcacacggtggcgtggcggtgaagaaacgaaggagtctaaaggaggaagaacaagctgctttgtgtctattgttattgtcttgtagctctgttttggcctga

SEQ ID NO: 148 - protein, 120 aa, Arabidopsis thaliana
MDPRKLLSCSSSYVSVRMKEEKGTIRCCSECKTTKTPMWRGGPTGPKSLCNACGIRHRKQRRSELLGIHIIRSHKSLASKKINLLSSSHGGVAVKKRRSLKEEEQAALCLLLLSCSSVLA

SEQ ID NO: 149 - DNA, 1653 bp, Arabidopsis thaliana
atggagcgatctcgctcagaaacgccatcgtctcgctcacgattgaagctgtgcttcataaactcgccgccatcatcgatattcacggggtccaagatcgaagctgaggatggttctccgcttgtgatcgagctcgtggacgccaccacaaacactctagttagtacgggaccgttctcgtcttctcgggtcgagctcgtgccgctgaacgctgatttcacggaagaaagctggaccgttgagggatttaatcggaatattctcacgcaacgtgaagggaaacgtccgttgctcactggagacctaacggtgatgcttaaaaacggtgttggagttataaccggagatatagctttctcggataactcgagctggactaggagtcggaagttccggttaggtgctaagttgaccggagatggagccgtggaggcgagaagtgaagcttttggatgtagagaccaacgaggagaatgggtctcaaagaaaacatggaacacaattgtatcacatgccatggattgcgttttggacgaaacagagtgttacatttacaatgcaaacactccgggcgtaacacttctcttcaactctgtttatgagttgataagagtgtcattcaatggcaacgatatccaaaaccttgatcagccaattctagaccaattaaaggccgaagcttatcaaaaccttaaccgcattacagcggttaacgataggacctttgtgggtcatccacaaaggtccttacagtgcccgcaagatcctggatttgtcgtaacatgttctggatcgcagcacatcgactttcaaggaagtttggatccatcaagctcttcgatggctctttgccacaaagcttcaagctcaacggtccaccctgatgtcctgatgagttttgataactcatcaaccgcgaggtttcatatcgacaaaaagttcttaccgactttcggaaacagcttcaaagtaagtgaactcgatcaagtacacggaaaatcacaaactgttgtgacaaaaggttgtatagagaataacgaggaggatgagaacgcgttttcttatcatcaccatgatgacatgacctcaagctggtcacctggtacgcaccaagccgttgaaacgatgtttcttaccgtgtctgagacggaagaagctggaatgttcgatgttcattttgcaaacgttaatttgggatctccaagagccaggtggtgtaaggttaaggcagctttcaaggttagggcagcttttaaggaagtccggagacacacaactgccagaaatccgagggaaggcttgaagctactatcttgttcatcctcttacgtgtcagtgagaatgaaagaagagaaggggacaattaggtgttgcagtgagtgtaagaccaccaagacaccaatgtggagaggtggaccaactggtcctaagtcactttgcaatgcatgtggaattagacacagaaaacagagacgatcagagttattgggtattcatattattcgcagccacaaaagcttagcctccaagaagataaacctattatcatcatcacacggtggcgtggcggtgaagaaacgaaggagtctaaaggaggaagaacaagctgctttgtgtctattgttattgtcttgtagctctgttttggcctaa

SEQ ID NO: 150 - protein, 550 aa, Arabidopsis thaliana
MERSRSETPSSRSRLKLCFINSPPSSIFTGSKIEAEDGSPLVIELVDATTNTLVSTGPFSSSRVELVPLNADFTEESWTVEGFNRNILTQREGKRPLLTGDLTVMLKNGVGVITGDIAFSDNSSWTRSRKFRLGAKLTGDGAVEARSEAFGCRDQRGEWVSKKTWNTIVSHAMDCVLDETECYIYNANTPGVTLLFNSVYELIRVSFNGNDIQNLDQPILDQLKAEAYQNLNRITAVNDRTFVGHPQRSLQCPQDPGFVVTCSGSQHIDFQGSLDPSSSSMALCHKASSSTVHPDVLMSFDNSSTARFHIDKKFLPTFGNSFKVSELDQVHGKSQTVVTKGCIENNEEDENAFSYHHHDDMTSSWSPGTHQAVETMFLTVSETEEAGMFDVHFANVNLGSPRARWCKVKAAFKVRAAFKEVRRHTTARNPREGLKLLSCSSSYVSVRMKEEKGTIRCCSECKTTKTPMWRGGPTGPKSLCNACGIRHRKQRRSELLGIHIIRSHKSLASKKINLLSSSHGGVAVKKRRSLKEEEQAALCLLLLSCSSVLA

SEQ ID NO: 151 - DNA, 363 bp, Arabidopsis thaliana
atggatccaaggaagctactatcttgttcatcctcttacgtgtcagtgagaatgaaagaagagaaggggacaattaggtgttgcagtgagtgtaagaccaccaagacaccaatgtggagaggtggaccaactggtcctaagtcactttgcaatgcatgtggaattagacacagaaaacagagacgatcagagttattgggtattcatattattcgcagccacaaaagcttagcctccaagaagataaacctattatcatcatcacacggtggcgtggcggtgaagaaacgaaggagtctaaaggaggaagaacaagctgctttgtgtctattgttattgtcttgtagctctgttttggccgga

SEQ ID NO: 152 - protein, 121 aa, Arabidopsis thaliana
MDPRKLLSCSSSYVSVRMKEEKGTIRCCSECKTTKTPMWRGGPTGPKSLCNACGIRHRKQRRSELLGIHIIRSHKSLASKKINLLSSSHGGVAVKKRRSLKEEEQAALCLLLLSCSSVLAG

SEQ ID NO: 153 - DNA, 363 bp, Arabidopsis thaliana
atggatccaaggaagctactatcttgttcatcctcttacgtgtcaatgagaatgaaagaagagaaggggacaattaggtgttgcagtgagtgtaagaccaccaagacaccaatgtggagaggtggaccaactggtcctaagtcactttgcaatgcatgtggaattagacacagaaaacagagacgatcagagttattgggtattcatattattcgcagccacaaaagcttagcctccaagaagataaacctattatcatcatcacacggtggcgtggcggtgaagaaacgaaggagtctaaaggaggaagaacaagctgctttgtgtctattgttattgtcttgtagctctgttttggcctaa

SEQ ID NO: 154 - protein, 120 aa, Arabidopsis thaliana
MDPRKLLSCSSSYVSMRMKEEKGTIRCCSECKTTKTPMWRGGPTGPKSLCNACGIRHRKQRRSELLGIHIIRSHKSLASKKINLLSSSHGGVAVKKRRSLKEEEQAALCLLLLSCSSVLA

SEQ ID NO: 155 - DNA, 1197 bp, Arabidopsis thaliana
atggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgtttcgatgatttgacaataatgttgagcaaaagctcagcttatcaacaagtgttcccacaagatgagaaggaggctgctgttttgctcatggctctgtcgtatggaatggttcacggttga

SEQ ID NO: 156 - protein, 398 aa, Arabidopsis thaliana
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSACDHMVPKKETRLKLTIRKKDHEDQPHPLHQNPTKPDSDSDKWLMSPKMRLIKKTITNNKQLIDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 157 - DNA, 1197 bp, Arabidopsis thaliana
atggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaataaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaagtctctttgtaacgcatgtggtatacggcaaagaaaggcaaggcgagccgctatggccgcggccgctgcagccggcgaccaagaggtggcggtagcgccccgagtgcaacaattaccgctgaaaaagaatttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttga

SEQ ID NO: 158 - protein, 398 aa, Arabidopsis thaliana
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSACDHMVPKKETRLKLTIRKKDHEDQPHPLHQNPTKPDSDSDKWLMSPKMRLIKKTITNNKQLIDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKNLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 159 - DNA, 1059 bp, Arabidopsis thaliana
atgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtga

SEQ ID NO: 160 - protein, 352 aa, Arabidopsis thaliana
MGSNFHYTIDLNEDQNHQPFFASLGSSLHHHLQQQQQQQQHFHHQASSNPSSLMSPSLSYFPFLINSRQDQVYVGYNNNTFHDVLDTHISQPLETKNFVSDGGSSSSDQMVPKKETRLKLTIKKKDNHQDQTDLPQSPIKDMTGTNSLKWISSKVRLMKKKKAIITTSDSSKQHTNNDQSSNLSNSERQNGYNNDCVIRICSDCNTTKTPLWRSGPRGPKSLCNACGIRQRKARRAAMATATATAVSGVSPPVMKKKMQNKNKISNGVYKILSPLPLKVNTCKRMITLEETALAEDLETQSNSTMLSSSDNIYFDDLALLLSKSSAYQQVFPQDEKEAAILLMALSHGMVHG

SEQ ID NO: 161 - DNA, 636 bp, Vitis vinifera
atggcggatgacaataagagcagccacaaattrtcggtttttaagaaggaagaaggagatgaaggtaataaaagtactgagaaatggatgtcttcaaagatgaggctgatgagaaaaatgatgaactcggattgcactacagcgaaaatcgagcagaaggttgaagatcatcagcagtgggacaatattaaygagwtcaactcttccaacaatactagtaatatcccaattagagtctgcagtgattgtaacacaaccaaaacccctctttggaggagyggtcctagaggtcccaagtcactttgcaatgcctgtggaattaggcaaaggaaggcgagacgagccatggcagcagcggcagcagcagcagcgaatggcacagccgttgggaccgagatatcgcctatgaagatgaagctgcccaacaaggaaaagaagatgcatacaagcaatgtagggcaacagaagaagctctgcaagcccccttgtcctcctcccaccgagaagaagctttgcttcgaagatttcacttcgagtatttgcaagaactcaggttttagacgagtgttccctcgggatgaagaagaagccgcgatcctcctaatggccttatcttgtgaccttgtttacagttga

SEQ ID NO: 162 - protein, 211 aa, Vitis vinifera
  misc_feature (66)..(66): Xaa can be any naturally occurring amino acid
MADDNKSSHKLSVFKKEEGDEGNKSTEKWMSSKMRLMRKMMNSDCTTAKIEQKVEDHQQWDNINEXNSSNNTSNIPIRVCSDCNTTKTPLWRSGPRGPKSLCNACGIRQRKARRAMAAAAAAAANGTAVGTEISPMKMKLPNKEKKMHTSNVGQQKKLCKPPCPPPTEKKLCFEDFTSSICKNSGFRRVFPRDEEEAAILLMALSCDLVYS

SEQ ID NO: 163 - DNA, 546 bp, Vitis vinifera
atgatctcggatcaaactggtgcccaaaaaccaagcaacactgcactcaattttggagatcacaagcagcaatccttgccttctgaaaccgattacaatagcatcaattcctctaatatcaacagcaacaacacaattagggtttgtgcagattgtaacacaactaagacccctctgtggaggagtggcccaagaggccctaagtctctctgcaacgcctgcggaatcaggcaaaggaaggctagacgggccatggctgctgctgctgcaactgctaatggcacaattcttccaaccaacacagcacccacaaagaccaaggccaagcacaaagacaagaagtcgagcaatggtcatgtttcacactacaagaaacggtgcaaactggctgcggccccatcttgtgaaacaaagaagctttgtttcgaggacttcaccataagcttgagtaagaattccgctttccaccgagttttcctccaagacgagatcaaggaagcggcgatcctgctaatggctctatcttgcggcctcgtccatggttga

SEQ ID NO: 164 - protein, 181 aa, Vitis vinifera
MISDQTGAQKPSNTALNFGDHKQQSLPSETDYNSINSSNINSNNTIRVCADCNTTKTPLWRSGPRGPKSLCNACGIRQRKARRAMAAAAATANGTILPTNTAPTKTKAKHKDKKSSNGHVSHYKKRCKLAAAPSCETKKLCFEDFTISLSKNSAFHRVFLQDEIKEAAILLMALSCGLVHG

SEQ ID NO: 165 - DNA, 420 bp, Arabidopsis thaliana
atgctagatcacagtgaaaaggtcttattggttgattcagaaaccatgaaaacaagagctgaagatatgatcgaacagaacaacactagtgttaacgacaagaagaagacttgtgctgattgtggaaccagtaaaactcctctttggcgtggtggtcctgttggtccaaagtcgttgtgtaacgcgtgtgggatcagaaacagaaagaagagaagaggaggaacagaagataataagaaattaaagaaatcgagttctggcggcggaaaccgtaaatttggtgaatcgttaaaacagagtttgatggatttggggataaggaagagatcaacggtggagaagcaacgacagaagcttggtgaagaagaacaagccgctgtgttactcatggctctttcttatggctctgtttacgcttag

SEQ ID NO: 166 - protein, 139 aa, Arabidopsis thaliana
MLDHSEKVLLVDSETMKTRAEDMIEQNNTSVNDKKKTCADCGTSKTPLWRGGPVGPKSLCNACGIRNRKKRRGGTEDNKKLKKSSSGGGNRKFGESLKQSLMDLGIRKRSTVEKQRQKLGEEEQAAVLLMALSYGSVYA

SEQ ID NO: 167 - DNA, 363 bp, Vitis vinifera
atgaacaacaaaaacccagatgctgtttcgtcggctgagagccaggttaacgagccgaagaagacctgcgctgattgtggcaccaccaaaacccctctctggagaggcggtccagctgggcctaagtctctgtgcaatgcatgtggtatcagaagcaggaagaagagaagagccttcctgggaagcagcaaccactcccataacaatggtggcggcaacgggaacaataaattgggggactcgctgaagaggaggctcttcgcattgggaagagaggtgttgttgcagagatcaacactgggagaagaagagcaagcggccgtactgttaatggctctgtcttacggctacgtctatgcttaa

SEQ ID NO: 168 - protein, 120 aa, Vitis vinifera
MNNKNPDAVSSAESQVNEPKKTCADCGTTKTPLWRGGPAGPKSLCNACGIRSRKKRRAFLGSSNHSHNNGGGNGNNKLGDSLKRRLFALGREVLLQRSTLGEEEQAAVLLMALSYGYVYA

SEQ ID NO: 169 - DNA, 378 bp, Vitis vinifera
atgatggatctgagcaaaaaggaatcattgtctgaggaaatgaatgagatcaagaaatgttgtactgattgcaagaccaccaagacgcccctgtggagaggtgggccagctgggcctaagtcactctgcaatgcatgtgggatcagatacaggaagaggaggagttccatggtgggtgtgaacaaaaagaaagagagaatgaacagtggtagccatgatttgagtgaaactttgaagcagtcactcatggctttggggaatgaggtgatgatgcagaggcagagatcttcagtgaagaaacagaggaggaagttgggggaagaagaacaagcagctgtactgttgatggcactctcatgtggctctgtttttgcctag

SEQ ID NO: 170 - protein, 125 aa, Vitis vinifera
MMDLSKKESLSEEMNEIKKCCTDCKTTKTPLWRGGPAGPKSLCNACGIRYRKRRSSMVGVNKKKERMNSGSHDLSETLKQSLMALGNEVMMQRQRSSVKKQRRKLGEEEQAAVLLMALSCGSVFA

SEQ ID NO: 171 - DNA, 411 bp, Oryza sativa
atggattcctcgtcggtcgagaaggggagtgggtcgatagatccggacgagcgcacggcctccggcgagcccaaggcgtgcaccgactgccacaccaccaagactccgctctggcgcggcggcccctccggccccaagtcgctatgcaacgcgtgcgggatccggtaccggaagaagagacgggaggcgctggggctcgacgccggcgagggcggcgcggagcggcaggagaagaagaagagcaagagggagagaggggaggaggtgaccatggagctccgcatggtggggttcgggaaggaggtggtcctgaagcagcggcggcggatgcggcggaggagacgcctcggcgaggaggagaaggcggccatcctcctcatggccctctcctccggagtcatctacgcctga

SEQ ID NO: 172 - protein, 136 aa, Oryza sativa
MDSSSVEKGSGSIDPDERTASGEPKACTDCHTTKTPLWRGGPSGPKSLCNACGIRYRKKRREALGLDAGEGGAERQEKKKSKRERGEEVTMELRMVGFGKEVVLKQRRRMRRRRRLGEEEKAAILLMALSSGVIYA

SEQ ID NO: 173 - DNA, 429 bp, Oryza sativa
atggatatggattcttcctcctccccggtggacaaggtggatcccgacgagtgcaacggctctaaggcttgcgctgactgccacactaccaagactccgctatggcgaggcggacccggaggacccaagtcgctgtgcaacgcatgcgggatccggtatcggaagaggcggcgggcggcgctcggcctggactcttccgccaccgccaccgccaccgacggagcggagcagcagaagaagactaaggccaagaaggaaaaggcacaggaggaggaggtcaccatggagctccacacggtgggcttccgcagcaaggacgctgctgtgttcaagcagcgccggcggatgcgccgcaggaaatgccttggcgaggaggagagggccgccatcctgctcatggcactctcctcgggcgtcatctacgcctga

SEQ ID NO: 174 - protein, 142 aa, Oryza sativa
MDMDSSSSPVDKVDPDECNGSKACADCHTTKTPLWRGGPGGPKSLCNACGIRYRKRRRAALGLDSSATATATDGAEQQKKTKAKKEKAQEEEVTMELHTVGFRSKDAAVFKQRRRMRRRKCLGEEERAAILLMALSSGVIYA

SEQ ID NO: 175 - DNA, 885 bp, Arabidopsis thaliana
atgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtgatggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggcttcaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatga

SEQ ID NO: 176 - protein, 295 aa, Arabidopsis thaliana
MMQTPYTTSTQGQYCHSCGMFHHHSQSCCYNNNNNSNAGSYSMVFSMQNGGVFEQNGEDYHHSSSLVDCTLSLGTPSTRLCEEDEKRRRSTSSGASSCISNFWDLIHTKNNNSKTAPYNNVPSFSANKPSRGCSGGGGGGGGGGGGDSLLARRCANCDTTSTPLWRNGPRGPKSLCNACGIRFKKEERRTTAATGNTVVGAAPVQTDQYGHHNSGYNNYHAATNNNNNNGTPWAHHHSTQRVPCNYPANEIRFMDDYGSGVANNVESDGAHGGVPFLSWRLNVADRASLVHDFTR

SEQ ID NO: 177 - DNA, 840 bp, Oryza sativa
atgcttcaccattactacagcggcggcgccggccatcatcaggacgtcgctgcagctggtagccccggcgacatggcttcctccaccttctcgctcttcttcccgatgtccaatgggcagtgttggccgccgtcgacggtggaggagtccgcggcctacgacgaccacagcaccgtcaccacctctccttcctcgccttcgtcgtcctccaccggctccgtcgactgcacgctctcgctcggcacgccgtcgtctcgccgcgccgagcccgtcgcggcggcggcgccagcggcaaaccatggggcgcccgtgccggcgcattatccgtcgctgtcagcggcgaccgtgtcctgggacgcgactgccgagtcgtactattgtggccagcaggggaggccggccaccggcgccgccaagtgcgccgccggcgccgggcacgacgcgctcctcgaccgccgctgcgccaactgcggcaccgcgtccacgccgctctggaggaacggccctcgcggacccaagtcgctgtgcaacgcgtgcgggatcaggtacaagaaggaggagcggcgcgcggcggcgacgacgacgacggccgacggcgccgccggatgcggcttcatcaccgcgcagcgtggacgcgggtcgaccgcggccaaggcggcgcccgccgtgacgacgtgcggcgaggagacgtcaccgtacgtcgtcggcggcggcggcggcggcggcgaggtcgcggacgcggcgtatctcgcctggcggctcaacgtcgtcccaccggcggcgacggcgacggcgttctcggtgtggccggagcgagctagcctctaccactacaactag

SEQ ID NO: 178 - protein, 279 aa, Oryza sativa
MLHHYYSGGAGHHQDVAAAGSPGDMASSTFSLFFPMSNGQCWPPSTVEESAAYDDHSTVTTSPSSPSSSSTGSVDCTLSLGTPSSRRAEPVAAAAPAANHGAPVPAHYPSLSAATVSWDATAESYYCGQQGRPATGAAKCAAGAGHDALLDRRCANCGTASTPLWRNGPRGPKSLCNACGIRYKKEERRAAATTTTADGAAGCGFITAQRGRGSTAAKAAPAVTTCGEETSPYVVGGGGGGGEVADAAYLAWRLNVVPPAATATAFSVWPERASLYHYN

SEQ ID NO: 179 - DNA, 56 bp, Artificial sequence
  primer: prm10106
ggggacaagtttgtacaaaaaagcaggcttaaacaatgcttcaccattactacagc

SEQ ID NO: 180 - DNA, 48 bp, Artificial sequence
  primer: prm10107
ggggaccactttgtacaagaaagctgggtccaacgctaatgctacact

SEQ ID NO: 181 - DNA, 1647 bp, Arabidopsis thaliana
atgggtcgttcgaaactagcttctcgtcctgctgaggaagacctgaatccaggaaaatcaaaaaggaaaaagatatcattgggtcctgagaatgctgcggcatcaatttccaccggaattgaagctgggaatgagaggaaacctggcctttactgttgtaactattgcgataaagatctgtctggtttggttcgtttcaaatgtgctgtttgtatggactttgatctttgtgtggaatgcttttctgtcggcgttgaacttaatcgtcacaagaacagtcacccatatcgtgttatggacaatttgtctttttcgcttgttacttctgattggaatgccgatgaagagatactccttcttgaggccattgcgacatacgggtttggcaattggaaagaagttgcagaccatgttggtagtaagacaacgacagaatgtattaaacacttcaattctgcttacatgcagtcaccatgctttccacttccggacttgtcccatactattggaaagagcaaagatgagctgcttgctatgagtaaagatagtgcagtcaaaacagaaatacctgcatttgtgaggctatctccaaaagaagagttacctgtgtcagctgaaatcaaacacgaagcttcagggaaggtcaatgaaatagatccacctttgtctgccttagctggagtcaagaagaaaggcaatgtaccgcaggctaaggacatcatcaagttggaagctgcaaaacaacaatctgacaggagtgtcggggagaagaaactcagacttcctggagagaaagttccattagtaacagagttatatggttacaatctaaagagggaagaatttgagatcgaacatgacaacgatgctgagcaactgcttgctgacatggaatttaaggattctgacacagatgctgagcgtgagcagaaactgcaggttcttcgtatttactcgaaaaggcttgatgagaggaagcggaggaaggaatttgttctggaaagaaacttgttgtaccctgatcaatatgagatgagcctttcagcagaggagagaaaaatatataaaagctgtaaagtgtttgcgcggttccaatccaaagaagagcacaaggaactgattaagaaagtcattgaagagcaccaaattctcagaagaatcgaggatcttcaggaagctagaactgctggttgcaggacaacttcagacgcaaatagatttatagaagagaagagaaagaaggaagctgaagaaagtatgctgctgcggcttaaccacggtgcaccaggcagtatagccggtaaaacactaaaaagtccaagagggttacccagaaatttgcatccctttggttctgactcactgccaaaggtcacacctccaagaatatacagcggtttggacacttgggatgttgatggtctccttggagctgacttactctcagagaccgaaaagaagatgtgcaatgagaccagaatactgcctgtacactatttgaagatgttggatatcttaacaagagaaataaagaaggggcagataaagaaaaagtctgatgcttatagcttcttcaaagtagagccgagtaaagtagacagagtatatgatatgctggttcataagggaataggtgactcaacatga

SEQ ID NO: 182 - protein, 548 aa, Arabidopsis thaliana
MGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDST

SEQ ID NO: 183 - DNA, 1464 bp, Arabidopsis thaliana
atgggtcgctctcgagggaacttccaaaatttcgaagaccctactcagagaacgaggaaaaagaaaaatgcggctaatgtggagaactttgagtctacttctttggtaccaggtgctgagggaggagggaagtataactgcgattattgccagaaagacattactggaaaaattaggataaagtgtgctgtctgtccagattttgatctctgtatagaatgtatgtctgttggagcagagatcactcctcacaaatgtgatcacccataccgagttatgggaaatctaactttcccgcttatttgtcctgactggagtgcggatgatgaaatgcttctcctggagggacttgaaatttatggcttgggaaactgggcagaggttgcggagcacgtgggaacgaagagtaaagaacagtgtcttgagcactacagaaacatctatttgaactcaccatttttcccacttccggatatgtcacatgtagcagggaagaacagaaaagaacttcaagccatggctaaaggacgcattgatgacaagaaagcagagcagaacatgaaagaagagtacccgttctctcctcctaaagtcaaagttgaagacacacaaaaagagtcttttgtagacagaagttttggagggaagaaacctgtttccacctcggtaaacaactctttggttgagctgagtaattacaaccagaaaagagaagagtttgaccctgaatatgacaatgatgctgagcaactcttggcggagatggagttcaaagagaacgatactcctgaagaacatgaactgaagctgcgtgtgttgcgtatctattcaaaaaggcttgatgagaggaaacgtagaaaagaattcataatagaaagaaacctgttgtacccaaatccctttgagaaggacctgtctcaggaggagaaagtacaatgccgacgtttggacgtttttatgcgttttcattcaaaagaggagcacgacgagctactccgtaatgttgtaagcgagtaccgcatggtgaaacggctcaaagatctcaaggaagctcaagtggcagggtgtcgttcaacggctgaagcagagaggtatctgggaaggaagaggaagagagaaaacgaagaagggatgaacagagggaaagagagcggtcaatttggtcaaattgcaggggagatgggctctagaccacctgtgcaagcttcttcaagctatgtgaatgatttggacttgattgggttcacggagtcgcaactgctgtctgaatccgagaagcgtctctgcagcgaggtcaagttggttccaccggtttatctacagatgcaacaagtgatgtcacatgagatattcaaagggaatgtaacgaagaagtcggatgcatatagccttttcaagattgatccaaccaaagtggatcgagtttatgatatgcttgtgaagaagggtattgctcaactttaa

SEQ ID NO: 184 - protein, 487 aa, Arabidopsis thaliana
MGRSRGNFQNFEDPTQRTRKKKNAANVENFESTSLVPGAEGGGKYNCDYCQKDITGKIRIKCAVCPDFDLCIECMSVGAEITPHKCDHPYRVMGNLTFPLICPDWSADDEMLLLEGLEIYGLGNWAEVAEHVGTKSKEQCLEHYRNIYLNSPFFPLPDMSHVAGKNRKELQAMAKGRIDDKKAEQNMKEEYPFSPPKVKVEDTQKESFVDRSFGGKKPVSTSVNNSLVELSNYNQKREEFDPEYDNDAEQLLAEMEFKENDTPEEHELKLRVLRIYSKRLDERKRRKEFIIERNLLYPNPFEKDLSQEEKVQCRRLDVFMRFHSKEEHDELLRNVVSEYRMVKRLKDLKEAQVAGCRSTAEAERYLGRKRKRENEEGMNRGKESGQFGQIAGEMGSRPPVQASSSYVNDLDLIGFTESQLLSESEKRLCSEVKLVPPVYLQMQQVMSHEIFKGNVTKKSDAYSLFKIDPTKVDRVYDMLVKKGIAQL

SEQ ID NO: 185 - DNA, 2745 bp, Dictyostelium discoideum
atgacttcaacaataaataaagaagaacctacaacacttgtaaataaaaaaaggagaaaagaacatgttgatgatgacgatgataatgatgatgacattgaaatgcaaaatgtatcaaatgataatattaataatacagatgatgaaaataataatgtaaatacaaatggaaataatacaaacaaaaccaacaacaacaacaacaacaacaacaacaacaacaacaataataatgaagaagatgacgatgaagaagacttattaattaccaaaagaaggaatagtagatcaacaacaatgagtaataatagtagtaataaatcaacaccatctaaaaagaaaagaattaagaaatcatatgataatgataaagattttgtaggagatgatgaagaggaagatgataatgatgatgaagatgatgatggtgatgttgtaatctcaaataataataataataataataataataatactaataataataataataataataatggtaatggtaatggtaataacaatacaaacaattcattcgaagaagatgatgatgaagaggatgatgatgaagaagatgaagaagaagaagaagaaggtatgaaaatatcaaaaagtaaaagacaaacacaaataataccaccaacacaaagtgaagttgatgatcttgtaaataaaagttttaatagtgtagatgatgatgaagaagataatgaagaggatgataaaacaaaaaatactactactactactgctacaaatactactaatgtaccaacaacaacaacaacaactacaacaacatcgaacaatactacattaccaactactaccactactaccaccactaataatacaacaaaaccaaatgttaaaatagaacaaccaaaaacacaacaaccaccacaaccacaaccaataaataaaccaactcaatcaaatactatcacaacaaatacaaatacaagtacaaatacaaacacagctacaaatacaaattcaaatacagctacagccacaacaacatcacctacctcaatgacaaaacaaacaaggaagtcaaccaattcaccaactaacagtaatggtaataataataataataataataataataattttatagaggaacaagtgaatgaaggattatatcattgtgattattgtcaaaaggatattagtggtgttgtacgtataagatgttcagtatgtactgatttcgatttatgtttagaatgttttagtgttggtgtagagattacaccacatcgtaattttcatgattatcatgtagttgataatatgcatttcccaatgtttactgatgattggggtgctgatgaagaattattacttttagaagcaattgaattatatggtttaggtaattggaatgaagtttcagagaatgtaggcgcacattcaaaatcacctttagaatgtaaagcacattatttcgctcattatttaaatagttcaacttcacctttaccagatacatcaaaggttttaactacaaatgaaaatgttcactttaaaagagcaaaaacaactgtaaatggtaattattataatgattatattattgataatagtgacgatgatgataataataataataataataattataacgataatagtaataatacaacaccaacaaagtcattcaatagtgttaataaaagtaaaaaattaaatcatagaaatagtcatggtgaagaaggaccaagtggaccagtaacagattcagttggatatatgaagaatagaggacattttgaagtagaatatgataatgaagcagagttggttgtaaaggatttaacatttgaacctgacgatagtcaagcagatagagatattaaattgaatgtattagaatcctatgatcaaagattggatgaacgtattagaagaaggaatttcattgttgagaaaggtttattagattatagaaaagtagagagaaaacgatacaaagatgataaagagatattaaattcattgaaatgtttccttcaaacagttaccaaagaagagcatgaatcaatgataaatggattaataaatgaaaagaatataaagaatagaattctacaattacaagagtatcgtgaaaatggtattaaaacattggcagatggtcaaaattttgatgaagataaaagaaaacgtgaagttgataaatctatgaaacgttccaaatctgaattggcatcatatagtttaaatagtggattaagttcatacaatccaaatcataatccatttggtcatcattatttaggtggtagtagtagtggattaagtggtggtagtggtggaggtggtggtggtggtggtgatccatcatttaaaactcaaaaacaattaactaaagaaaaagaagatatttatttaggtattggtgagaataggaaacatcattcaagtaaattgaaaaagaatgctaaaatggaattggaaggtttaccaaatgctgatgcactctcattaaaagagaaacaaatttgtacaactcataaacttttaccacaacaatacctaattgtcaaacaagcattaatctctgaatctttaaaaactcaaggtgtaattaaattatcaaccgcttttaaactaattaaattaaatcaagttaaaattcatagacttttagaattctttgaaagaaatcattggttaaaatttaatattgattgtgaaactaacacttctaatactacttcaaattataaataa

SEQ ID NO: 186 - protein, 914 aa, Dictyostelium discoideum
MTSTINKEEPTTLVNKKRRKEHVDDDDDNDDDIEMQNVSNDNINNTDDENNNVNTNGNNTNKTNNNNNNNNNNNNNNNEEDDDEEDLLITKRRNSRSTTMSNNSSNKSTPSKKKRIKKSYDNDKDFVGDDEEEDDNDDEDDDGDVVISNNNNNNNNNNTNNNNNNNNGNGNGNNNTNNSFEEDDDEEDDDEEDEEEEEEGMKISKSKRQTQIIPPTQSEVDDLVNKSFNSVDDDEEDNEEDDKTKNTTTTTATNTTNVPTTTTTTTTTSNNTTLPTTTTTTTTNNTTKPNVKIEQPKTQQPPQPQPINKPTQSNTITTNTNTSTNTNTATNTNSNTATATTTSPTSMTKQTRKSTNSPTNSNGNNNNNNNNNNFIEEQVNEGLYHCDYCQKDISGVVRIRCSVCTDFDLCLECFSVGVEITPHRNFHDYHVVDNMHFPMFTDDWGADEELLLLEAIELYGLGNWNEVSENVGAHSKSPLECKAHYFAHYLNSSTSPLPDTSKVLTTNENVHFKRAKTTVNGNYYNDYIIDNSDDDDNNNNNNNYNDNSNNTTPTKSFNSVNKSKKLNHRNSHGEEGPSGPVTDSVGYMKNRGHFEVEYDNEAELVVKDLTFEPDDSQADRDIKLNVLESYDQRLDERIRRRNFIVEKGLLDYRKVERKRYKDDKEILNSLKCFLQTVTKEEHESMINGLINEKNIKNRILQLQEYRENGIKTLADGQNFDEDKRKREVDKSMKRSKSELASYSLNSGLSSYNPNHNPFGHHYLGGSSSGLSGGSGGGGGGGGDPSFKTQKQLTKEKEDIYLGIGENRKHHSSKLKKNAKMELEGLPNADALSLKEKQICTTHKLLPQQYLIVKQALISESLKTQGVIKLSTAFKLIKLNQVKIHRLLEFFERNHWLKFNIDCETNTSNTTSNYK

SEQ ID NO: 187 - DNA, 1683 bp, Lycopersicum esculentum
atgggtcgttctcgggctgttcatcaatccactgatgatgatccaagccagaggtctaagagaaaaagggcagtgccaaatgtggagagttttgatactgcagctactggccaaatattgactgaagggaaaaaggctttgtaccattgcaattattgcaataaagacatatctggaaggattcggattaaatgtgttgtgtgttctgactttgatctttgtgtggaatgcttttctgttggagcagaagtgcagcctcacaaaagcaatcatctgtatagggttatggataacctgtcatttcctctcatatgtgctgactggaatgctgatgaggaaatgttacttctagagggtttggaaatgtacggattggcaaactgggctgaagttgccgaacatgttggaacgaagagtaaacagcagtgtattgaccactataagtccacctatattagttctccttgttttccgcttccggacatgtcccatgttatgggaaagaacagagaggaacttcttgccatggccaaggatcaaggatatgcagctcccgggggagttaatgttaaagaagagtctccattctctgcaggaatcaagatggaagatcaaagggaagaaaattcaactggacttgcctcagttggaggttctgcttctggtacattagcaggagctggaaagaggacatctagcttacttcatagtaaggagaatcatgatagcatcaaagtggaaggttgtcctgcagacaggagtgtcggagagaaaaagcctaggtcatcagtggacgaggggccttccatgacagaattaagtggttataattccaagagagaggagtttgaaattgaatacgataatgatgctgagcagatggtggctgatatggaatttaaagagacagataccaatgctgagcgtgaactgaaacttcgggtattgcgtatatacaataaaaggcttgatgagaggaaacgtaggaaggattttattttggaaaggaaactacttcatcctgatccttttgagaaagacctcaccccggaggagaaggacatatgccgtcgttacagggtgttcatgcgttttagttctaaagaggagcatgaggatttccttaggagcataatcgaggagcaccgaatagttaaacgaatacgagatcttcaggatgcccgaattgctggttgccgaactttagctgaggcagaaagatatgttgaacaaaagagagcgcgggaatctgaagaaaatatacgtagactgaaggagaacacccagagtggcccaagtggaaaatatttgcaaagagcaggtcactttaaagtggagcatgacagcagccccagaggagttggtaggggccctgaaatgatggattgttgcaatgacttatcatcaaccaccgcaccacatggtgttggaagtgctgtagacatttgggatgtcagtgggttttcaggagctgagttgctctcagaagctgaaaaaaagctttgtgatgagatgagaatcctgccggctcattatctaaacatgtcgcaaaccatgtccatggggatctttaatggcaacatcaccaagaaatctgatgcgcatggtctattcaatgttgatccgaataagattgacaaagtgtatgagatgcttgtcaaaaagggcctggctcaagcataa

SEQ ID NO: 188 - protein, 560 aa, Lycopersicum esculentum
MGRSRAVHQSTDDDPSQRSKRKRAVPNVESFDTAATGQILTEGKKALYHCNYCNKDISGRIRIKCVVCSDFDLCVECFSVGAEVQPHKSNHLYRVMDNLSFPLICADWNADEEMLLLEGLEMYGLANWAEVAEHVGTKSKQQCIDHYKSTYISSPCFPLPDMSHVMGKNREELLAMAKDQGYAAPGGVNVKEESPFSAGIKMEDQREENSTGLASVGGSASGTLAGAGKRTSSLLHSKENHDSIKVEGCPADRSVGEKKPRSSVDEGPSMTELSGYNSKREEFEIEYDNDAEQMVADMEFKETDTNAERELKLRVLRIYNKRLDERKRRKDFILERKLLHPDPFEKDLTPEEKDICRRYRVFMRFSSKEEHEDFLRSIIEEHRIVKRIRDLQDARIAGCRTLAEAERYVEQKRARESEENIRRLKENTQSGPSGKYLQRAGHFKVEHDSSPRGVGRGPEMMDCCNDLSSTTAPHGVGSAVDIWDVSGFSGAELLSEAEKKLCDEMRILPAHYLNMSQTMSMGIFNGNITKKSDAHGLFNVDPNKIDKVYEMLVKKGLAQA

SEQ ID NO: 189 - DNA, 1632 bp, Lycopersicum esculentum
atgggtcgctctcgtgggaattttcaagctgatgaagatcccagccaaagatcaaggaggaaaaagaatgcctcaagtgtagacaatttagaatctgcgaccactggtcaagggacagctgatggcaaaagggccttgtatcactgcaattattgcaacaaagacattagcgggagaactcgtataaaatgtgctgtatgttacgattttgacctatgtatagagtgcttctctgttggtgctgaggtgcatccccacaaaagccatcaccactatagggttatggatatcttagctttcccgcttatttgcccagactggaatgctgatgaagagatgttgctccttgagggaattgagatgtatggcatgggtaattgggctgaagtaggtgagcatgtcggaacaaagacaaaagaagcctgcattgaccattttaaggatgcgtacttaaagtcaccttactttcctctaccagatatgactcacgtcatggggaaaaacagaatggaactccttgccatggctaaagggaatttcactgataagaaaggactctcttcacttggtgatgttgctcctaaagatgaatcgttctctccgtctcgaatcaaagttgaagacactcataaaattggtccttcaggacgtttaacttctgtatccaatgcgggaatcacaggcataaaaaagccatccagcaaaacgctaatcaaagatcaaaatgaacctgttaaatttgaagataattcaggcagaaattttggaggcaagaaaccgaaatctttgaaggatgatggatcctcattgatgaaattaagtggatatattcccaagaggcaagaatttgatcctgaatatgataatgatgcggagcaactattggctgatatggaattcaaggaaactgaaactgaagaggagcgcgaacttaagctgcgtgttctgcgtatctattccaagaggcttgatgaaagaaaacgccgcaaggtttttattctagagaggaatttactccagccaagtgaatttgagaagaatttgtcaccagaagagaaaggtatatgccgatgttatgatgccattatgcgctttctctcgaaggaggagcatgaagaattacttaaggctgtggtctcagaacatagatatctgaaaagaatacaagaactcaaggaagcgaaagctgcaggttgtcgttcgtctgctgaagttgataggtacttagaaaggaaaaggaagaaggaagttgaagaaggtgttccgagaaagggaagctctcagattggcccaatgagccaggaaagcctgaacatacctgcttcttctgagtcacttggaatacattcaaatagaaaaccttgtagccaggcgattttgagttccgacaccaatgcaggtgttccagctttttctgcaggagaactgttatctgaacctgagaaacaactatgtcaagaaatcaggttatcgccgcatcattatcttaggatgcaggaggtccttacaatacaaatttatagtggtaatatcactagaaaatcagatgcttatcctttgtttcaaatagaagcaactaaagtagatagagtttatgatatgcttttgaagaaaggagttgcacccttgtaa

SEQ ID NO: 190 - protein, 543 aa, Lycopersicum esculentum
MGRSRGNFQADEDPSQRSRRKKNASSVDNLESATTGQGTADGKRALYHCNYCNKDISGRTRIKCAVCYDFDLCIECFSVGAEVHPHKSHHHYRVMDILAFPLICPDWNADEEMLLLEGIEMYGMGNWAEVGEHVGTKTKEACIDHFKDAYLKSPYFPLPDMTHVMGKNRMELLAMAKGNFTDKKGLSSLGDVAPKDESFSPSRIKVEDTHKIGPSGRLTSVSNAGITGIKKPSSKTLIKDQNEPVKFEDNSGRNFGGKKPKSLKDDGSSLMKLSGYIPKRQEFDPEYDNDAEQLLADMEFKETETEEERELKLRVLRIYSKRLDERKRRKVFILERNLLQPSEFEKNLSPEEKGICRCYDAIMRFLSKEEHEELLKAVVSEHRYLKRIQELKEAKAAGCRSSAEVDRYLERKRKKEVEEGVPRKGSSQIGPMSQESLNIPASSESLGIHSNRKPCSQAILSSDTNAGVPAFSAGELLSEPEKQLCQEIRLSPHHYLRMQEVLTIQIYSGNITRKSDAYPLFQIEATKVDRVYDMLLKKGVAPL

SEQ ID NO: 191 - DNA, 1548 bp, Ostreococcus lucimarinus
atggcgagcgcgctcgtgccgaaacggcgacgggtggcgacggaaaacgcgatgacgaagctgagtgggaacggggagtcgtgcgcactgtttaactgtaactattgccaaaaggacatctcgaacgtggtgcgcgtacggtgcgcggagtgcgcaaacgtggatctgtgcacggagtgcttcgcggtcggcgtggagccgcacccgcacaaggcgtatcatcagtatcacgtcatcgacaacatgtcgtttccgctgttcacgcgagattggggggctgacgaagagttgttattgctggaggcagtggagatgttcgggttggggaactggaccgaggtgagcgaacacgtcgggacgaagacgcgcgcgcagtgtcacgcgcactattttgaagtctacgtcaagtctccttgcgcgccgttaccggatatgtcgaagattttaggaaaaggcgtcgcgcgtatgacatcagacgagctcaaagcggaggcggagcaaaaggcgaacgaaaataaggatgtggaggaggaggagaagcttctcgaatcgcttgctaacccgaacgcagtgaagacggagggcaacgtgcaggaactcacaggttacaacatcaagcgcaatgagttcgatcccgaatacgacatggatgccgaacttcccctggcggagatggaatttcgcgaaaacgacaccgaagaagacgtccagatgaagctgcgaatgattgaaatctacaacagccggcttcaagaacgagcgagaagaaaacaattcattctcgaacgcaatctgctgaacgtgaaaaagcaacaaaacgtggaaaagaagcgttcacaatacgagcgcgacttacacggcaccatgcgtatatttgcacgctttctcacgagtaccgagtacgacgtcttgctcgagggtctcgccgcggagcaccgaatccgaacccgcatcaccgaactgaaagagtacagacgcaatggtattcataccatcgcagagggcgaggattacgatttggagaagcgtcgtcgtgagacggagttcgctcgtctacacgcgatcgagcatccaactagcaagaacatagccagagcgaacaacttaggtcctcgccgtcgaatgtacttgtcacttgatctcgccgatcttccaggcgtagaccttttgaacgacgacgaaaaggagttgtgcaggagctgtcgcttattgcctgtgcagtatctctcgatgaaggtggagttgatgcgagagggtctcaagtccgaaaagccgctcaacagaaatcacgttcggaatatgttcaaagtagacccactcaaggctattcgtgtgtatgagttactcctacagcacggctgggtgttggaagacggcttcgtgaacccaggtgaggatgaagactccgaacctgcgccgaaaaagtcagccagcgcagacgaggaggaagacgaggaggacgatgaagtagattacgaaaccgacgataacgacgaagacgaggacgaggaagacgacgaggaagaggatagcgaggaagacgattag

SEQ ID NO: 192 - protein, 515 aa, Ostreococcus lucimarinus
MASALVPKRRRVATENAMTKLSGNGESCALFNCNYCQKDISNVVRVRCAECANVDLCTECFAVGVEPHPHKAYHQYHVIDNMSFPLFTRDWGADEELLLLEAVEMFGLGNWTEVSEHVGTKTRAQCHAHYFEVYVKSPCAPLPDMSKILGKGVARMTSDELKAEAEQKANENKDVEEEEKLLESLANPNAVKTEGNVQELTGYNIKRNEFDPEYDMDAELPLAEMEFRENDTEEDVQMKLRMIEIYNSRLQERARRKQFILERNLLNVKKQQNVEKKRSQYERDLHGTMRIFARFLTSTEYDVLLEGLAAEHRIRTRITELKEYRRNGIHTIAEGEDYDLEKRRRETEFARLHAIEHPTSKNIARANNLGPRRRMYLSLDLADLPGVDLLNDDEKELCRSCRLLPVQYLSMKVELMREGLKSEKPLNRNHVRNMFKVDPLKAIRVYELLLQHGWVLEDGFVNPGEDEDSEPAPKKSASADEEEDEEDDEVDYETDDNDEDEDEEDDEEEDSEEDD

SEQ ID NO: 193 - DNA, 1704 bp, Oryza sativa
atgggccggtctcgcggggtgcccaattccggcgacgatgaaacgaaccacaggtcgaagcggaggagggtcgcgtcgagcggcgatgcgccggactcgctctcggcggcctgcgggggagccggagagggtggtgggaagaaggcgctgtaccactgcaactactgcaataaggatatttccgggaagatccggatcaagtgctccaagtgccccgacttcgacctctgcgtcgagtgcttctcggtcggcgccgaggtcaccccgcaccgcagcaaccatccttacagggtcatggacaacctgtctttccctcttatttgtccagattggaatgcagacgaggaaatccttcttctagagggaattgaaatgtatggtctgggaaattgggctgaagttgcggagcatgttggcaccaagaccaaggcacaatgcattgatcattatacaactgcatacatgaactcaccttgttatccccttccggatatgtctcatgttaacggtaagaacaggaaggaattgcttgctatggctaaagtacaaggcgagagtaaaaaagtgttaccaggggatttgacccctaaggacgagtctccattttctcccccaagggtcaaggtggaagatgcacttggagaaggtttagctggtcgatcaccttcacacatagctgggggtgcaaataagaaagcatcaaatgttggacaattcaaagatggtgctaatgtagcaaaagttgaagatggtcatgtggatagaagtataggtgtgaaaaaaccccgatattctgcagatgaagggccttctttgactgaactgagtggatacaattcaaagagacatgaatttgacccagagtatgataacgatgctgaacaggcactcgctgagatggagtttaaagaaactgattcggaaactgatcgtgaactgaagctaagggtattgcgtatttacttgtcaaggcttgatgaaagaaaaaggagaaaagagttcatactggaaagaaacttactatttcctaatcctttggagaaggatctcacaaatgaagacaaggaagtttaccatcgctataaggtgttcatgcgtttcctttctaaggaggaacatgaagcacttgttaggagtgttcttgaggaacggaaaattcgaaggaggattcaagagcttcaggaatgtcgttctgctggatgccgtacattggctgaagcaaagattcacatagagcaaaagaggaaaaaggaacatgaggtgaatgcccaaaaagctaaggaaagtggtcagctcttatccaacactaaagtggtgcataagacgaatcgacctatgaaaatcgagtcagatggtaatttggatcagaagaaaggtggtgccagcttggattctactggcagggattctccaaaaaccacagggcatgcaggcactaaacattgggatgactgggatattgttggttttcctggggcagagctattaagcaccagtgaaaaaaatctatgctgtcagaacagattgctacccaaccattacctgaaaatgcaggaggttttgatgcaggaaatattcaagggtagtgtcgccaagaaggaagatgcccatgtattatttaaggttgaccctgccaaagtagataacgtttatgatatggtgacgaaaaagttgggtaccaatgaggaggccccgactgtttag

SEQ ID NO: 194 - protein, 567 aa, Oryza sativa
MGRSRGVPNSGDDETNHRSKRRRVASSGDAPDSLSAACGGAGEGGGKKALYHCNYCNKDISGKIRIKCSKCPDFDLCVECFSVGAEVTPHRSNHPYRVMDNLSFPLICPDWNADEEILLLEGIEMYGLGNWAEVAEHVGTKTKAQCIDHYTTAYMNSPCYPLPDMSHVNGKNRKELLAMAKVQGESKKVLPGDLTPKDESPFSPPRVKVEDALGEGLAGRSPSHIAGGANKKASNVGQFKDGANVAKVEDGHVDRSIGVKKPRYSADEGPSLTELSGYNSKRHEFDPEYDNDAEQALAEMEFKETDSETDRELKLRVLRIYLSRLDERKRRKEFILERNLLFPNPLEKDLTNEDKEVYHRYKVFMRFLSKEEHEALVRSVLEERKIRRRIQELQECRSAGCRTLAEAKIHIEQKRKKEHEVNAQKAKESGQLLSNTKVVHKTNRPMKIESDGNLDQKKGGASLDSTGRDSPKTTGHAGTKHWDDWDIVGFPGAELLSTSEKNLCCQNRLLPNHYLKMQEVLMQEIFKGSVAKKEDAHVLFKVDPAKVDNVYDMVTKKLGTNEEAPTV

SEQ ID NO: 195 - DNA, 1683 bp, Populus trichocarpa
atgggtcgttctcgagggaattttcactctaatgatgaagaccctactcagagatcaagaaggaagaagaatgcggcaagtggagataattccgaatctttattggctggccaaggaagtggtgatgggaaaagggcattataccattgcaattattgcaataaagatataacagggaagacccgtatcaaatgcgctatgtgccctgattttgacctatgcttagagtgcttctctgtaggagctgaggttacacctcataaaagcaatcacccttacagggttatggataatttatctttcccgcttatttgccctgattggaatgcagatgaagaaatactgcttctagagggaattgaaatgtatggattggggaactgggcagaaattgctgagcacgtggggacaaagagtaaagacacatgtattgaacactataatagtgtttacatgcaatcccagtacttccctctcccggacatgtcgcttgttgttgggaaaaatagaaaggaacttcttgctatggccaagggatatagtgaggacaaaaaaggtgctgctatgcttggggatcttactttgaaggaagaatctccattttctccttcaagagtgaaagtcgaagaaatgcataaaggaggttcctctggccgattatcaacattaaactcagaggtagaatctgctggccgtcctactaccacaaactctgcagcaacagctgctaataagaaggcatctagcattgctcgggttaaagatggacctaatgttgttaaagtggaagatcctcaggtggaccgaaatgctaaagggaagaaaccgaattcctctgggagtgagggtccatctttaatggagttgagcggttataaccccaagaggcaggagtttgatcccgaatatgataatgatgctgagcagttgctagctgagatggaatttaaagatactgacactgaggaagagcgggagctgaaattgcgagtgctgcatatatattcaaagcggctcgacgagagaaagcgcagaaaagatttcatactagaaagaaatctgctgcaaccaagtccttttgaaaaggacttgactccagaagagagggcattatgtcggcgttatgaccctttcatgcgttttcattccaaggaagagcatgaggaattgcttcaggttgttatcgaagagcatcggatgctgaaaaggatcgaagagctgaaggaagctcaagcagctggttgccgcacagcagctgaggcggacaggtaccttgagcagaagaggaaaaaagaagccgaggaaaattccagtagactgaaagacaatgctctggttggtcctagcaaccatggtgctcccaatgcatttattccgtcagagtctgttaggaaggattcgagtactagacctgtaggacagggctctgctagctatgccaatggtttggacacaacaggcttttatgaaacgcagctactatctgaaactgaaaaacggctatgccgtgagattcacctacctcctcctgtctacctcaagatgcaagaggtcatgaccaaagagatcttcagcggtaacatcactaagaaattggatgctcaccccttgttcaagattgaagcaagcaaagttgatagggtgtatgatatacttgtgaagaaggggattgctcaaccttga

SEQ ID NO: 196 - protein, 560 aa, Populus trichocarpa
MGRSRGNFHSNDEDPTQRSRRKKNAASGDNSESLLAGQGSGDGKRALYHCNYCNKDITGKTRIKCAMCPDFDLCLECFSVGAEVTPHKSNHPYRVMDNLSFPLICPDWNADEEILLLEGIEMYGLGNWAEIAEHVGTKSKDTCIEHYNSVYMQSQYFPLPDMSLVVGKNRKELLAMAKGYSEDKKGAAMLGDLTLKEESPFSPSRVKVEEMHKGGSSGRLSTLNSEVESAGRPTTTNSAATAANKKASSIARVKDGPNVVKVEDPQVDRNAKGKKPNSSGSEGPSLMELSGYNPKRQEFDPEYDNDAEQLLAEMEFKDTDTEEERELKLRVLHIYSKRLDERKRRKDFILERNLLQPSPFEKDLTPEERALCRRYDPFMRFHSKEEHEELLQVVIEEHRMLKRIEELKEAQAAGCRTAAEADRYLEQKRKKEAEENSSRLKDNALVGPSNHGAPNAFIPSESVRKDSSTRPVGQGSASYANGLDTTGFYETQLLSETEKRLCREIHLPPPVYLKMQEVMTKEIFSGNITKKLDAHPLFKIEASKVDRVYDILVKKGIAQP

SEQ ID NO: 197 - DNA, 1623 bp, Populus trichocarpa
atgggtcgttcgcgcggtcgccctccttcttccggaacctccactgccgccgccgcctctgatgatccaaacaatagatcttcaaaaagaaaaaagacgacttccaatgtagggagtatagagactgcatttccagcagtatatcaagaaaagggtcaagggaaactggcactataccactgcaattactgtcataaagacatctctggaatggttcgcattaagtgtgcagtgtgtcctgatttcgacctttgcgttgagtgtttttctgttggagccgaagtgactcctcataaaagcaatcatccctacagggttatggacaatctgtcttttccgctctttcatccagactggaatacagatgaagagatattacttctagagggcattgaaatgtatggatttgggaactggactgaagtttcagaacatgctggaaccaagagcaaatctcaatgcattgatcactataatgctgtatacatggactccccatgctttcctctcccagacatgtctcatgttatgggaaaaacaagagaggagctccttgcaatggccagaggaaatgttgaaatgaagaaagaagtcagctctcatatgggttcaagcagtggcaacacattctcagatgcagttaagaaagcatctaacgaggcccagattaaggataagattaaagtggaagaacctctgtctgacaggagtattcgagagaaaaaacctagaatttgcggagaggaaggaccttcaatgacagagttaagtggctataatttcaagaggcaggaatttgagattgaatatgataatgatgcagagcaactactggcagatatggaattcaaagatactgacactgatgctgagcttgacatgaaactgcaagttctgcgcatttactcaaaaaggcttgatgagaggaaacggaggaaagattttattttggaaagaaatttgttttaccctgatgcatttgagaagaacatttcacctgaagagaaggaaatatatcagcgttacaaggtcttcatgaggttccacacaaaagaagagcatgaagaattgatgaagactgttattgaagatcatcagattatgaaaagaatacaagatcttcaggaagctcgagctgctggctgtcaaacagctggtgaggcccaaggatttattgagcagaagagaaagaaggaagccgaagaaagtgcccaaagagcgaaggaaagtatgcaagcaggcccagcaggtaaactgttgccaaagccaaatcatcttgacagcagccctcgtggagctgtcaagtgttccaccgtttttcatcctggtggcaacgactcatcttcaatgattgcaaaacaagcaatttcaagcaccctcgatgagtgggatattgctggattcctaggggctgatttgctctctgaatctgataagcgtctttgttgtgagttgagaatactacctgcacattatctcaacatgctgcacataatgtcaatagagataacaaagggtactgttaccaacaaaaccgatgctcatagcctgttcaaggtggaatcaagcaaagtggatagagtatatgatatgttagtgaaaaaggggattgctctagcatga

SEQ ID NO: 198 - protein, 540 aa, Populus trichocarpa
MGRSRGRPPSSGTSTAAAASDDPNNRSSKRKKTTSNVGSIETAFPAVYQEKGQGKLALYHCNYCHKDISGMVRIKCAVCPDFDLCVECFSVGAEVTPHKSNHPYRVMDNLSFPLFHPDWNTDEEILLLEGIEMYGFGNWTEVSEHAGTKSKSQCIDHYNAVYMDSPCFPLPDMSHVMGKTREELLAMARGNVEMKKEVSSHMGSSSGNTFSDAVKKASNEAQIKDKIKVEEPLSDRSIREKKPRICGEEGPSMTELSGYNFKRQEFEIEYDNDAEQLLADMEFKDTDTDAELDMKLQVLRIYSKRLDERKRRKDFILERNLFYPDAFEKNISPEEKEIYQRYKVFMRFHTKEEHEELMKTVIEDHQIMKRIQDLQEARAAGCQTAGEAQGFIEQKRKKEAEESAQRAKESMQAGPAGKLLPKPNHLDSSPRGAVKCSTVFHPGGNDSSSMIAKQAISSTLDEWDIAGFLGADLLSESDKRLCCELRILPAHYLNMLHIMSIEITKGTVTNKTDAHSLFKVESSKVDRVYDMLVKKGIALA

SEQ ID NO: 199 - DNA, 1680 bp, Populus trichocarpa
atgggtcgttctcgtgggaattttcactctactgatgaagaccctactcagagatcaagaaggaaaaagaacgctgcaagtggagagaattcggaatcttcatcggcaggccaaggaagtagtgatggtaaaagggcattataccattgcaattattgcaataaagacataacagggaagacccgtatcaaatgtgctgtgtgccctgattttgacctatgtttagagtgcttctctgtaggagctgaggttacgcctcataaaagcaatcacccttacagggttatggataacctatctttcccacttatttgccctgactggaatgcagatgaagaaatactgcttctagagggaattgaaatgtatggattggggaattgggcagaagttgctgagcatgtggggacaaagaataaagaaacatgtatcaaacactataatagcgtatacttgcaatcccagttcttccctctcccggacatgtctcatgttgttgggaaaaatagaaaggagcttcttgctatggccaagggacatagtgaggacaaaaaaggtacttctatgcttggggagcatactttgaaggaagaatctccattttctccttcaagagtcaaggtcgaagaaatgcataaagtaggttcctctggccgattatcaacattaaattcagagttagaaactgcgagccgtcctaatagcgcaaattctgcagcaacagctgctaataagaaggcatcaagcatggcccgaattaatgatggacccggtgttaaggtggaagatcctcaagtggaccgaaatttcaaggggaagaaaccaagttcctcagggagtgagggtccatcattaatggagttgagcggttataatcccaagaggcaggagtttgatcctgaatatgacaatgatgctgagcagttgctggctgagatggaatttaaagataatgacactgaggaagagcgtgagctgaagttgcgagtgctgcgtatatattcaaggaggcttgatgagagaaagcgcagaaaagatttcattcttgaaagaaatctactacatccaagtcctttcgaaaaggacttgactccagaagagagggcattatgtcggcgttttgaccctttcatgcgttttcattccaaggaagagcatgaagaactgcttcgggctgttgtcaaggagcactggatgctgaaaagggtcgaagagctgaaggatgcccaagtggctggttgccgcacagcagttgaggcagacaggtatcttgagcacaagagaaaaatagaagctgaggaaacttccaggagactgaaagacaatgctcagattggtcctagcagtcagggtgctcccaatgcattcatgtctccagactctgttgggaaggattcaagcaccagacctgcaggacagggctcttctagctatgccaatgatttggacataatgggcttttatgaaacgcagctactgtctgaaactgaaaaacggctatgctgcgagattcacctacctccacctgtctacctcaagatgcaggaggtgatgaccaaagagatcttcagcggtaacatcactaagaaatcagatgctcaccccttgttcaagattgaagcaagcaaagttgatggggtgtatgatatgcttgtgaagaaggggattgctcaaccttga

SEQ ID NO: 200 - protein, 559 aa, Populus trichocarpa
MGRSRGNFHSTDEDPTQRSRRKKNAASGENSESSSAGQGSSDGKRALYHCNYCNKDITGKTRIKCAVCPDFDLCLECFSVGAEVTPHKSNHPYRVMDNLSFPLICPDWNADEEILLLEGIEMYGLGNWAEVAEHVGTKNKETCIKHYNSVYLQSQFFPLPDMSHVVGKNRKELLAMAKGHSEDKKGTSMLGEHTLKEESPFSPSRVKVEEMHKVGSSGRLSTLNSELETASRPNSANSAATAANKKASSMARINDGPGVKVEDPQVDRNFKGKKPSSSGSEGPSLMELSGYNPKRQEFDPEYDNDAEQLLAEMEFKDNDTEEERELKLRVLRIYSRRLDERKRRKDFILERNLLHPSPFEKDLTPEERALCRRFDPFMRFHSKEEHEELLRAVVKEHWMLKRVEELKDAQVAGCRTAVEADRYLEHKRKIEAEETSRRLKDNAQIGPSSQGAPNAFMSPDSVGKDSSTRPAGQGSSSYANDLDIMGFYETQLLSETEKRLCCEIHLPPPVYLKMQEVMTKEIFSGNITKKSDAHPLFKIEASKVDGVYDMLVKKGIAQP

SEQ ID NO: 201 - DNA, 1722 bp, Vitis vinifera
atgggtcgttctcgcgcagttctgcattctactgacgatgatcaaggttcacacagatccaagagaagaaagactgcttcaacagcagacaatttagagggtgcaactgcaggccaaggaatgagtgaggggaagmgagcttcataccactgtaattattgcagcaaagatatctcaggaaagatccgtaccaaatgtgtagtttgtcccgattttgacctttgcattgaatgcttttccattggagctgaggttacacctcaygtatgctttcatccatatcgggtcatggacaatttatcgttcccactcatttgtcctgattggaatgcagatgaagagatgttacttctggagggaattgaaatgtacggactggggaactggagtgaagtttcagaacatgttggaaccaaaagaaaatcagaatgtatcgatcactatgttgctatatacatgaattccccatgctttcctcttcctgacatgtcccatgttcttggaaagactagggctgagctccttgccatggccaggggagaagatgaagtcaagaaaggatcccctacacatggggagttaactctgaaagtggaatctcccttatctgcaagagtcaagtacggcaaatgcatgctaaaatgtgtttctctcatctgtcagagatccaatccgacatggatttctagcagcactaaaacatctgcaggtgcagttaagagggcatctaacatggcccaggttaaggatggtcgtgataacattaaagtggaagaaactcaaacagacagaagtgttggagagaaaaagcctaggacctcgggggatgaggggccttctgtgacagagctgagtggatacaatttcaagaggcaagagtttgatgttgagtatgataatgatgctgagcagttactggctgatatggaattcaaggatgctgacactgatgctgagcatgaactgaaactgcaagttctgcatatttattccaaaaggcttgatgagaggaaacgcaggaaggatttcatattggaaagaaatctactttaccctgacccttttgagaagaacctctcacctgaagagagggacgtaaatcagcgcttcaaggtctttatgcggttccactcaaaagaagaacatgaggaactgcttagggttgtgctcgaggaacattggattcagaaaagaatacaagatcttcaggacgcccgagctgctggctgccgtacatctgctgaggcagagagatatcttgaagagaaagggaagaaagaagctgaagaaagtgcccaacaagcaaaggaaagtgctgaggctggtcctagtgggggtaaagtcttacagagggtgaacactgccaaaggagaatctgatggcagtcctcggggaggtggaagaggttctgcaggtctagaacctggaatcaaggacacttcttcaacaactgcaggacatgctatcttaagatccctagatgtttgggatatcactggatttccgggggaagatttactctcagaaactgagaaacagctttgcagtgagatcagaatcctcccttcacattatctcaacatgctgcacaccatgttgacagagacgttaaatggaaacatcaccaggaaatcagatgcccatggcctgttcaaggttgaaccaagcaaagtagacaaagtgtacgatatgtttgtgaagaagggaattgttaagtcatag

SEQ ID NO: 202 - protein, 573 aa, Vitis vinifera
MGRSRAVLHSTDDDQGSHRSKRRKTASTADNLEGATAGQGMSEGKRASYHCNYCSKDISGKIRTKCVVCPDFDLCIECFSIGAEVTPHVCFHPYRVMDNLSFPLICPDWNADEEMLLLEGIEMYGLGNWSEVSEHVGTKRKSECIDHYVAIYMNSPCFPLPDMSHVLGKTRAELLAMARGEDEVKKGSPTHGELTLKVESPLSARVKYGKCMLKCVSLICQRSNPTWISSSTKTSAGAVKRASNMAQVKDGRDNIKVEETQTDRSVGEKKPRTSGDEGPSVTELSGYNFKRQEFDVEYDNDAEQLLADMEFKDADTDAEHELKLQVLHIYSKRLDERKRRKDFILERNLLYPDPFEKNLSPEERDVNQRFKVFMRFHSKEEHEELLRVVLEEHWIQKRIQDLQDARAAGCRTSAEAERYLEEKGKKEAEESAQQAKESAEAGPSGGKVLQRVNTAKGESDGSPRGGGRGSAGLEPGIKDTSSTTAGHAILRSLDVWDITGFPGEDLLSETEKQLCSEIRILPSHYLNMLHTMLTETLNGNITRKSDAHGLFKVEPSKVDKVYDMFVKKGIVKS

SEQ ID NO: 203 - DNA, 1698 bp, Zea mays
atggggcggtcgcgaggggtgcagaattccggcgacgacgacaccgtacacaggtcgaagcggaggagggtcgcatcgggcggggatgcgacggactccgtttccgctggcatcgggggagctggagaaggagggggcaagaaagcgctctaccactgcaattactgcaacaaggacatctctgggaagatacggatcaaatgctccaagtgccctgacttcgacctttgcgtggagtgcttctctgttggcgctgaagtcaccccacatcgcagcaaccatccttacaaagtcatggacaacctgtctttcccacttatttgcccagattggaatgcagacgaagaaattctcctccttgagggaattgaaatgtatggtctgggaaactggcttgaagttgcagagcatgttggtaccaagtctaagttacagtgtattgatcattacacaacagcatacatgaactcaccttgttatcccctaccggatatgtctcatgttaatggcaagaacaggaaggagcttctagctatggctaaagtgcagggtgaaagtaaaaaagggacttcactgttgcctggagagctgactcctaaggctgaatctccattttctccctccagggtcaaggtggaagatgcacttggagaaggtctagcaggtcgatcaccttcgcacatagctgttggtgcaaataaaaaagcttcaaatgtgggacatattaaagatgggtctaatgtatcaaaagttgaagatggtcatgtcgatagaagtgttggtgtgaagaagcccagatattctgcagatgaaggcccttcgttgactgaactgagtggatacaatgcaaagagacacgagtttgacccagagtatgataatgatgccgaacaagcgcttgctgagatggaatttaaagaaactgattcagaaactgatcgtgaactgaaactccgtgtgctgcgtatttatctgtccaggcttgatgaaagaaaaaggagaaaagagttcatattggaaaggaatttattgtttcctaatcccttggagaaggatcttacaaatgaagacagggaagtttaccatcggtataaggtcttcatgcgttttctttccaaggaggaacatgaagcccttgttaggagtgtcattgaagagcgaaaaattcggaggagaattcaagaactccaggaatgtcgttctgctggatgccgcacacttgctgaagcaaagatacacatagagcaaaagaggaaaaaagaatacgagctgaatgcccaaaaagctaaggaaagtaaccaccttattgcaaatactaaattggtgcagaagatgaatcgacctatgaagattgagtctgatgggaatttggatccaaagaaaggtggtgttgcgttagattctcctaaaactacaggacttacaagtgttaagcagtgggatgactgggatatagttggtcttcctggggcgaagctattaagtgctagcgaaaagcttctatgttgccagaacagactgctacccagtcattacctgagaatgcaggaggtgctgatgcaggagatattcaagggtagtgtcctaaagaaggaagacgcacacgtcttgtttaaggttgatcctaccaaagtagatagtgtttatgatatggtaacaaaaaagctgggcaaccatgtggagttgcctacggtctag

SEQ ID NO: 204 - protein, 565 aa, Zea mays
MGRSRGVQNSGDDDTVHRSKRRRVASGGDATDSVSAGIGGAGEGGGKKALYHCNYCNKDISGKIRIKCSKCPDFDLCVECFSVGAEVTPHRSNHPYKVMDNLSFPLICPDWNADEEILLLEGIEMYGLGNWLEVAEHVGTKSKLQCIDHYTTAYMNSPCYPLPDMSHVNGKNRKELLAMAKVQGESKKGTSLLPGELTPKAESPFSPSRVKVEDALGEGLAGRSPSHIAVGANKKASNVGHIKDGSNVSKVEDGHVDRSVGVKKPRYSADEGPSLTELSGYNAKRHEFDPEYDNDAEQALAEMEFKETDSETDRELKLRVLRIYLSRLDERKRRKEFILERNLLFPNPLEKDLTNEDREVYHRYKVFMRFLSKEEHEALVRSVIEERKIRRRIQELQECRSAGCRTLAEAKIHIEQKRKKEYELNAQKAKESNHLIANTKLVQKMNRPMKIESDGNLDPKKGGVALDSPKTTGLTSVKQWDDWDIVGLPGAKLLSASEKLLCCQNRLLPSHYLRMQEVLMQEIFKGSVLKKEDAHVLFKVDPTKVDSVYDMVTKKLGNHVELPTV

SEQ ID NO: 205 - DNA, 1698 bp, Zea mays
atggggcggtcgcgaggggtgctgagttccggcgacgacgacaccgggcacaggtcgaagcggaggagagtctcgtcgggcggggatgcgacggactccatttcagcctccatcgggggagctggagagggagggggcaagaaggcgctctatcactgcaactactgcaacaaggacatctccgggaagatacggatcaagtgctccaagtgccctgacttcgacctttgcgtggagtgtttctctgtcggcgctgaagtcaccccgcaccgcagcaaccatccttacaaagtcatggacaacttgtctttcccacttatttgcccggattggaatgcagatgaagaaattctcctccttgagggaattgaaatgtatggtctgggaaactggcttgaagttgcagagcatgttggtaccaagtctaagttacagtgtattgatcattacacatcagcatacatgaactcaccttgttatcccctcccggatatgtctcatgttaatggcaagaataggaaggaacttctagctatggctaaagtacagggtgagagtaaaaaagggactttgctgttacctggagaactcactcctaaggttgaatctcaattttctccctccagggtcaaggtggaagatgcacttggagaaggtccagcaggtcgatcaccttcacacatggctgttggtgcaaataaaaaagcttcaaatgtgggacatattaaggatggcgctactgtatcaaaagtcgaagatgttcatgtagatagaagtgttggtgtgaagaagcccagatattctgcagatgaaggcccttcgttgactgaactgagtggatacaatgcaaagagacatgagtttgacccagaatacgataatgatgccgaacaagctcttgctgagatggaatttaaagaaactgattcggaaactgatcgtgaactgaaactccgtgtgctgcgtatttacctctccaggcttgatgaaagaaaaagaagaaaggagttcatattggaaagaaatttgttgttccctaatcccttggagaaggatcttacgagtgaagacagggaactttaccatcgctataaagtcttcatgcgttttctttctaaggaggaacatgaagccctcgttaggagtgttattgaggagcgaaaaattcggaggagaattcaagaactccaggaatgccgttctgctggatgccgcacactggctgaagcaaagatacacatagagcaaaagaggaaaaaagaatacgagctgaatgcgcaaaaagctaaggatagcagtcaacttaatgcaaataataaatcagtacaaaagatgaatcgacctatgaaaattgagtccgatgggaatttggatccaaagaaaggtggtgctggcttggattctcctaagacaacaggacctacaagtgttaagcagtgggatgactgggatatagttggtcttcctggggcagagctattaagtgctagcgaaaagcttctatgctgtcagaacagattgctacccagccattacctgagaatgcaggaggtgctgatgcaggagatattcaagggtagcgtcctaaagaaggaagacgcccacgtcttatttaaggtcgatcctaccaaagtagatagtgtttatgatatggtatctaaaaaactgggcaaccatgaggaggccccaaccgtctag

SEQ ID NO: 206 - protein, 565 aa, Zea mays
MGRSRGVLSSGDDDTGHRSKRRRVSSGGDATDSISASIGGAGEGGGKKALYHCNYCNKDISGKIRIKCSKCPDFDLCVECFSVGAEVTPHRSNHPYKVMDNLSFPLICPDWNADEEILLLEGIEMYGLGNWLEVAEHVGTKSKLQCIDHYTSAYMNSPCYPLPDMSHVNGKNRKELLAMAKVQGESKKGTLLLPGELTPKVESQFSPSRVKVEDALGEGPAGRSPSHMAVGANKKASNVGHIKDGATVSKVEDVHVDRSVGVKKPRYSADEGPSLTELSGYNAKRHEFDPEYDNDAEQALAEMEFKETDSETDRELKLRVLRIYLSRLDERKRRKEFILERNLLFPNPLEKDLTSEDRELYHRYKVFMRFLSKEEHEALVRSVIEERKIRRRIQELQECRSAGCRTLAEAKIHIEQKRKKEYELNAQKAKDSSQLNANNKSVQKMNRPMKIESDGNLDPKKGGAGLDSPKTTGPTSVKQWDDWDIVGLPGAELLSASEKLLCCQNRLLPSHYLRMQEVLMQEIFKGSVLKKEDAHVLFKVDPTKVDSVYDMVSKKLGNHEEAPTV

SEQ ID NO: 207 - protein, 46 aa, Artificial sequence
  Zinc finger ZZ type
KPGLYCCNYCDKDLSGLVRFKCAVCMDFDLCVECFSVGVELNRHKN

SEQ ID NO: 208 - protein, 49 aa, Artificial sequence
  SANT DNA binding domain
VTSDWNADEEILLLEAIATYGFGNWKEVADHVGSKTTTECIKHFNSAYM

SEQ ID NO: 209 - protein, 13 aa, Artificial sequence
  calcium binding EF hand
DNDAEQLLADMEF

SEQ ID NO: 210 - protein, 88 aa, Artificial sequence
  SWIRM domain
PRIYSGLDTWDVDGLLGADLLSETEKKMCNETRILPVHYLKMLDILTREIKKGQIKKKSDAYSFFKVEPSKVDRVYDMLVHKGIGDST

SEQ ID NO: 211 - DNA, 55 bp, Artificial sequence
  primer 1
ggggacaagtttgtacaaaaaagcaggcttaaacaatgggtcgttcgaaactagc

SEQ ID NO: 212 - DNA, 52 bp, Artificial sequence
  primer 2
ggggaccactttgtacaagaaagctgggtcatgttaggaccatgaagctatg

SEQ ID NO: 213 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcggccttctcgcaggattcagcc

SEQ ID NO: 214 - DNA, 1244 bp, Oryza sativa
aaaaccaccgagggacctgatctgcaccggttttgatagttgagggacccgttgtgtctggttttccgatcgagggacgaaaatcggattcggtgtaaagttaagggacctcagatgaacttattccggagcatgattgggaagggaggacataaggcccatgtcgcatgtgtttggacggtccagatctccagatcactcagcaggatcggccgcgttcgcgtagcacccgcggtttgattcggcttcccgcaaggcggcggccggtggccgtgccgccgtagcttccgccggaagcgagcacgccgccgccgccgacccggctctgcgtttgcaccgccttgcacgcgatacatcgggatagatagctactactctctccgtttcacaatgtaaatcattctactattttccacattcatattgatgttaatgaatatagacatatatatctatttagattcattaacatcaatatgaatgtaggaaatgctagaatgacttacattgtgaattgtgaaatggacgaagtacctacgatggatggatgcaggatcatgaaagaattaatgcaagatcgtatctgccgcatgcaaaatcttactaattgcgctgcatatatgcatgacagcctgcatgcgggcgtgtaagcgtgttcatccattaggaagtaaccttgtcattacttataccagtactacatactatatagtattgatttcatgagcaaatctacaaaactggaaagcaataagaaatacgggactggaaaagactcaacattaatcaccaaatatttcgccttctccagcagaatatatatctctccatcttgatcactgtacacactgacagtgtacgcataaacgcagcagccagcttaactgtcgtctcaccgtcgcacactggccttccatctcaggctagctttctcagccacccatcgtacatgtcaactcggcgcgcgcacaggcacaaattacgtacaaaacgcatgaccaaatcaaaaccaccggagaagaatcgctcccgcgcgcggcggcgacgcgcacgtacgaacgcacgcacgcacgcccaaccccacgacacgatcgcgcgcgacgccggcgacaccggccgtccacccgcgccctcacctcgccgactataaatacgtaggcatctgcttgatcttgtcatccatctcaccaccaaaaaaaaaaggaaaaaaaaacaaaacacaccaagccaaataaaagcgacaa

SEQ ID NO: 215 - DNA, 1482 bp, Arabidopsis thaliana
atgttttttggaccaagtgagtttgatgctgatgaaatgggttatgcaatgagtagacttgagatagaatccgatctatgtgatactggaaaagacgtttgtggagttggtagtagtagtggtagtcacagatcaagtgaacatttggctgatctagaccatgaaatcagccaggttactaaattgaaatctagtcctcatcaacggtatagccgtgaagtccctgggagacatcagttacctgtgtctactgtgaggatgttggcaggtcgagaaagtaatttctctggaagaggaaggttttcagccgctgattgttgccatatgctaagcagatatttgcctacaaaaggtccttggcttgtagatcaaatggacagccgagcatatgtctctcagttttcaactgatggttctctctttattgcggggtttcagggtagccgtattcggatttacaatgtagagaagggttggaaagttcaaaaggatattcttgcaaaaagcttgcgttggactgttactgatacttctctatcccctgatcagcgaaatctggtttacgcaagcatgtcacctattgttcacattgttgatgttggatccggttcaaccgagtctcatgcaaatgttacggagatccatgatggcttagacttctcttctgatgaagatggagggtactcttttggaatattctctgtgaaattttcaacagatggccgagaagttgttgctgggagcagtgatgattccatttatgtttatgaccttgaagcaaatcgagtttcactccggactgttgcacacacgtctgatgtaaatactgtgtgctttgctgatgaaagtgggaacctgattttatctggaagtgatgataatctctgcaaagtgtgggataggcgttgtttcattgggagagataagccagctggtgttttagtgggacacctcgaaggtgttacctttatcgatagccgtggagatggtcgctatttcatatcaaatggtaaagaccaaactatcaaattgtgggatatcagaaaaatgtcctcaagcgcacctgcaaggcatgaggtgctaagaaactatgaatgggactacagatggatggattatcctactgaagcaagagatctaaagcacccactcgatcagtcagtgtcgacatataaaggtcactcagttttgcgtactctcatccgttgttacttctctccagcgcatagtactggccaaaagtacatctacacaggatcgaacgacagttccgtctacatatacgacttggtaagtggagataaagtggcagtgctaaagcaccatagctcacctgtaagagactgtaattggcacccatattacccaacgcttataagctcttcgtgggacggagatcttgtgaagtgggaatttccggggagcggtgaggcgccgattatgagtaagaagagggttcgaaggagacatttctactactga

SEQ ID NO: 216 - protein, 493 aa, Arabidopsis thaliana
MFFGPSEFDADEMGYAMSRLEIESDLCDTGKDVCGVGSSSGSHRSSEHLADLDHEISQVTKLKSSPHQRYSREVPGRHQLPVSTVRMLAGRESNFSGRGRFSAADCCHMLSRYLPTKGPWLVDQMDSRAYVSQFSTDGSLFIAGFQGSRIRIYNVEKGWKVQKDILAKSLRWTVTDTSLSPDQRNLVYASMSPIVHIVDVGSGSTESHANVTEIHDGLDFSSDEDGGYSFGIFSVKFSTDGREVVAGSSDDSIYVYDLEANRVSLRTVAHTSDVNTVCFADESGNLILSGSDDNLCKVWDRRCFIGRDKPAGVLVGHLEGVTFIDSRGDGRYFISNGKDQTIKLWDIRKMSSSAPARHEVLRNYEWDYRWMDYPTEARDLKHPLDQSVSTYKGHSVLRTLIRCYFSPAHSTGQKYIYTGSNDSSVYIYDLVSGDKVAVLKHHSSPVRDCNWHPYYPTLISSSWDGDLVKWEFPGSGEAPIMSKKRVRRRHFYY

SEQ ID NO: 217 - DNA, 1458 bp, Aquilegia formosa x Aquilegia pubescens
atgtttgttacagccagtggggttgacattgatgaaatggggtacgccatgagtaggctagagatagaatccgagttgttcgatggcggtaataccgtccatgaagccagtagcagtactaggcccggcaaactgtttcctaaagtagatgacgagatttcccagcttacaaacctcagatcagggcctaatgatcgactgcatcaacttgtgcccggaaagcagcaattacctgtttccccggtgaggatgttggcaggtcgagaaagtaattattcaggaaagggaaggttctcgtcagcggatcgttgtcacatgcttagcaggtatttgcctgtaaatggtccttggcttgtggaccagacgaccagtcgggcctatgtttctcaattttcagctgatggttctctatttgttgccgggtttcagggaagcgatattagaatatacaatgtggatagaggctggaaagttcagaagaacattcttgccaaaagtttgcgttggactgttactgacacatccctttcccctgatcagcgccatcttgtttataccagtatgtcacccatagtccatattgttaatgttgggtctgctaccacggaatcccttgcaaatataacagaggtccatgaaggattggacttctctgctgctgatggagggtattcttttggaatattctctgtgaaattttcaaccgatggacgagaacttgttgctggaagcagtgatgattcgatatatgtttatgatcttgaagcaaacaagctttcccttcgaattgcggcacacatggctgatgttaatactgtaacctttgctgatgaaagtggtaatctgatatattcaggaagtgatgataatctctgcaaggtgtgggacaggcgttgtctcagagcaaagggaaaaccagcaggggttttgacggggcatttagaaggcattacgtttattgatagccgtggagatggtcgatattttatatcaaatggaaaagaccaggccattaaactttgggacatcaggaaaatgtcggctaatgctagttgcattgcaaaatctagaaattacgaatgggactacagatggatggaatacccaactgaggcgagaaagttaaaacatccttgtgatcagtctttggctacatacaaagggcactctgtcttgcgtactctcatccgttgttacttttcaccggcttacagcactggccagaagtacatctacaccggatcaaatgatggttgcgtttatatatatgatttggtaagtggagcccaagttgctcgactagatcatcattcatccactgtgagggattgtagttggcaccctttctacccaacgcttgtcagcagttcatgggatggggtccttgccagatgtgaatttcctggcaatggagaaaaaattcggctgaagagaagcaggaggagatatgaatcttga

SEQ ID NO: 218 - protein, 485 aa, Aquilegia formosa x Aquilegia pubescens
MFVTASGVDIDEMGYAMSRLEIESELFDGGNTVHEASSSTRPGKLFPKVDDEISQLTNLRSGPNDRLHQLVPGKQQLPVSPVRMLAGRESNYSGKGRFSSADRCHMLSRYLPVNGPWLVDQTTSRAYVSQFSADGSLFVAGFQGSDIRIYNVDRGWKVQKNILAKSLRWTVTDTSLSPDQRHLVYTSMSPIVHIVNVGSATTESLANITEVHEGLDFSAADGGYSFGIFSVKFSTDGRELVAGSSDDSIYVYDLEANKLSLRIAAHMADVNTVTFADESGNLIYSGSDDNLCKVWDRRCLRAKGKPAGVLTGHLEGITFIDSRGDGRYFISNGKDQAIKLWDIRKMSANASCIAKSRNYEWDYRWMEYPTEARKLKHPCDQSLATYKGHSVLRTLIRCYFSPAYSTGQKYIYTGSNDGCVYIYDLVSGAQVARLDHHSSTVRDCSWHPFYPTLVSSSWDGVLARCEFPGNGEKIRLKRSRRRYES

SEQ ID NO: 219 - DNA, 1488 bp, Brassica napus
atgttttctggaccaagtgattctgatactgatgaaatgggttatgcaatgagtagactcgagattgaatccgatctatgcgacgctggaaagggctattacggtgttggtagcagcagtggtagtagtcacagatcgagtgagcgtttgggtgatttagacaatgagatcagccaagtcactaagctgaagtcttgtcctcatgaacggtttagccgtcaagtacccgggaggcatcagttgcctgtttccactgtgaagatgttggctggtcgtgagagtaacttctctggaagaggaggaaggttttcttcagctgatcgttgtcatatcttgagtagatatttgcctgttaagggtccttggcttgtggatcagatggacagccgagcttatgtctctcagttttcaactgatgggtctctcttcattgctgggtttcagggaagccatattcggatttacaatgtagagaaaggttggaaagttcaaaaggatattcttgcaaagagcttgcgttggactgttactgatacttctctgtcccctgatcagcgaaacctggtttatgcaagcatgtcacctattgttcacatagtcgatgttggatctggtacaaccgagtctcacgcaaatgtcacggagatccatgatggattagacttctcttctgaagaagatggaggctactcttttgggatattctctgtgaaattttcaacagatggacgagaactcgttgctggtagcagtgatgattccatttacgtttatgatctcgaagcaaaccgagtctcactccggactgttgcacacacgtctgatgtgaacactgtgtgtttcgccgatgaaagtggacacctgattctctctggaggtgatgataatctctgcaaggtgtgggataggcgttgtttcattgggagagataagccagctggtgttctggtgggacacctagaaggtgttacatttatcgatagccgcggagatggtcgctatttcatatcaaatgggaaagaccaaaccatcaagctatgggatattagaaaaatgtcctcaactgtacctgcaaggaatgaggtgcacagaaactatgaatgggattacagatggatggattacccttcggaggcaagagatctaaagcacccttatgatcagtctgtgtctacatataagggtcactcagtgttgcgtactctcatccgttgctacttctctccagctcatagtactggtcaaaagtacatatacacaggatccaacgacagttctgtctacatatatgacttggaaagtggagataaagcggcggtgttaaagcaccatagctcacctgtgagagactgtaactggcatccgcattatccgacgcttataagctcgtcgtgggacggagatcttgtgaaatgggagtttcctgggagcggtgaggcgccgatcatgagcaagaagagggtccgaaggagacatttctactactga

SEQ ID NO: 220 - protein, 495 aa, Brassica napus
MFSGPSDSDTDEMGYAMSRLEIESDLCDAGKGYYGVGSSSGSSHRSSERLGDLDNEISQVTKLKSCPHERFSRQVPGRHQLPVSTVKMLAGRESNFSGRGGRFSSADRCHILSRYLPVKGPWLVDQMDSRAYVSQFSTDGSLFIAGFQGSHIRIYNVEKGWKVQKDILAKSLRWTVTDTSLSPDQRNLVYASMSPIVHIVDVGSGTTESHANVTEIHDGLDFSSEEDGGYSFGIFSVKFSTDGRELVAGSSDDSIYVYDLEANRVSLRTVAHTSDVNTVCFADESGHLILSGGDDNLCKVWDRRCFIGRDKPAGVLVGHLEGVTFIDSRGDGRYFISNGKDQTIKLWDIRKMSSTVPARNEVHRNYEWDYRWMDYPSEARDLKHPYDQSVSTYKGHSVLRTLIRCYFSPAHSTGQKYIYTGSNDSSVYIYDLESGDKAAVLKHHSSPVRDCNWHPHYPTLISSSWDGDLVKWEFPGSGEAPIMSKKRVRRRHFYY

SEQ ID NO: 221 - DNA, 1428 bp, Glycine max
atgagttggttgaataaaaataaaagtacttgtagtgatggtagtgccaataatgaatcttcttcaagtggaatagttggagaaagggataatcatcttgatcatgaaattgcacagctcacaaaacttaggtcaagtcctcatgagcttttgggtcgtgttgttcctggtaagatgaggttacctgcatctactgtgagaatgctggttggtagagaaggtaattattctggaagagggagattttcatcagcagatgggtgtcatgtgttaagccgctatttgcctaccaaaggtccttggattgtggatcggatgaaaagtcgtgcctatgtttcacagttttctgctgatggttctcttttaattgctggattccagggaagccacatcaggatctatgatgttgaccagggctggaaagttaaaaaggacatttctgctagaaagttacggtggacagttactgatacatctctctcgccagatcaactctatcttgtttatgccagtatgtcaccaattatccatattgttaccgtgggatctggcacaacagaatcaatagcaaatgttacagaaattcactatggattaaatttctcttctgataatggtgatgatgaatttggaattttctctgtcaaattttcaacggatgggcgagagcttgtggctggaactagtgattgctcgatatgtgtatatgatcttggagcagataagctgagccttagaattcctgctcaccagtctgatgttaacactgtctgctttgctgatgaatctggccatctaatattttccggtagtgatgatagttttatcaaggtgtgggataggcgttgttttgtcgccaaaggacaaccagctggtatcttaatgggacatttagaaggcattacattcattgatagccgtggggatggtcgatatttaatttctaatggaaaagatcaaactaccaaattatgggatataaggaagatgtcttctaatgcaataaatcttggccttggagatgatgagtgggactatcgatggatggactaccctgaatatgcaagaaatttaaagcatcctcatgatcagtcattagcaacatataaaggtcactcagtgttgcgtactttagtgcgctgttatttctctccttcgtatagcactggtcaaaagtacatttacacagggtctagtgattcatctgtttacatatatgacctggtaagtggtgcacaagttgcaaaacttgatcatcatgaggcacctgtaagggattgtagttggcacccctattatccaatgatgatctcttcggcttgggatggtgatgttgtcaggtgggaatttcctgggagtgatgaagcccctgcttctccaaataaaagagaaggtcgaattcgtaggagaaatttgctttatctatag

SEQ ID NO: 222 - protein, 475 aa, Glycine max
MSWLNKNKSTCSDGSANNESSSSGIVGERDNHLDHEIAQLTKLRSSPHELLGRVVPGKMRLPASTVRMLVGREGNYSGRGRFSSADGCHVLSRYLPTKGPWIVDRMKSRAYVSQFSADGSLLIAGFQGSHIRIYDVDQGWKVKKDISARKLRWTVTDTSLSPDQLYLVYASMSPIIHIVTVGSGTTESIANVTEIHYGLNFSSDNGDDEFGIFSVKFSTDGRELVAGTSDCSICVYDLGADKLSLRIPAHQSDVNTVCFADESGHLIFSGSDDSFIKVWDRRCFVAKGQPAGILMGHLEGITFIDSRGDGRYLISNGKDQTTKLWDIRKMSSNAINLGLGDDEWDYRWMDYPEYARNLKHPHDQSLATYKGHSVLRTLVRCYFSPSYSTGQKYIYTGSSDSSVYIYDLVSGAQVAKLDHHEAPVRDCSWHPYYPMMISSAWDGDVVRWEFPGSDEAPASPNKREGRIRRRNLLYL

SEQ ID NO: 223 - DNA, 1467 bp, Gossypium hirsutum
atgtttgttacagccagtggggttgacattgatgaaatggggtacgccatgagtaggctagagatagaatccgagttgttcgatggcggtaataccgtccatgaagccagtagcagtactaggcccggcaaactgtttcctaaagtagatgacgagatttcccagcttacaaacctcagatcagggcctaatgatcgactgcatcaacttgtgcccggaaagcagcaattacctgtttccccggtgaggatgttggcaggtcgagaaagtaattattcaggaaagggaaggttctcgtcagcggatcgttgtcacatgcttagcaggtatttgcctgtaaatggtccttggcttgtggaccagacgaccagtcgggcctatgtttctcaattttcagctgatggttctctatttgttgccgggtttcagggaagcaatattaggatatacaatgtggatagaggttggaaagttcaaaagaacattcttgctaaaagtttgcgttggacagttaccgacacatccctttctccggatcagcggtaccttgtttataccagcatgtcgcctgtagttcacattgttaatgttgggtcttctaccacggaatcctttgcaaatgtcacggagatccacgaaggattggacttttcttctaatgatcgaaggtattcttttggaatattctccgtgaaattttcaactgatggacgagaacttgtggctggaagcagtgatgactcgatatatgtttatgatctggaagcaaacaagctttcccttcgaattatggcacacacggctgatgttaacacggcaacctttgccgatgaaagcggcaatttgatatattctgggagtgatgattatctctgcatggtgtgggataggcgttgctttggagcaaaagataagccggcaggagttttggtgggacacctggaaggtattacattcctcgacagtcgtggggatggtcgttacttcatatcaaacggtaaagatcagactatcaagctttgggatatccggaaaatgtcctccgatacctcttgcaatttagggtatcggaatttcgaatgggattacagatggatggactaccctccacaggctagagatttgaaacacccaagtgacggatcagtggctacttataaaggtcactcagtgttgcgcactcttattcgctgttatttttcacccgaatactgcacgggccaaaagtacatttacaccggatctcacgattctcgggtttatatttatgatgtggtcaccggagcccaagttgcggtactgaagcaccatacatcaccagtaagagactgtagttggcacccgcattaccctgtgttggtcagctcctcttgggacggggacgtggttaagtgggaattccctggtaaaggagaagcgccggtccttgcgaacgagaggagagtcaggaggcaatatcacgattga

SEQ ID NO: 224 - protein, 488 aa, Gossypium hirsutum
MFVTASGVDIDEMGYAMSRLEIESELFDGGNTVHEASSSTRPGKLFPKVDDEISQLTNLRSGPNDRLHQLVPGKQQLPVSPVRMLAGRESNYSGKGRFSSADRCHMLSRYLPVNGPWLVDQTTSRAYVSQFSADGSLFVAGFQGSNIRIYNVDRGWKVQKNILAKSLRWTVTDTSLSPDQRYLVYTSMSPVVHIVNVGSSTTESFANVTEIHEGLDFSSNDRRYSFGIFSVKFSTDGRELVAGSSDDSIYVYDLEANKLSLRIMAHTADVNTATFADESGNLIYSGSDDYLCMVWDRRCFGAKDKPAGVLVGHLEGITFLDSRGDGRYFISNGKDQTIKLWDIRKMSSDTSCNLGYRNFEWDYRWMDYPPQARDLKHPSDGSVATYKGHSVLRTLIRCYFSPEYCTGQKYIYTGSHDSRVYIYDVVTGAQVAVLKHHTSPVRDCSWHPHYPVLVSSSWDGDVVKWEFPGKGEAPVLANERRVRRQYHD

SEQ ID NO: 225 - DNA, 1464 bp, Helianthus annuus
atgtactctaggggttggaccacacttataggtgacatgggatatgccctaagtagattggaaatcgacccagattattctgataacggatctgttggagacgataatgacagccaccagtcttcatcacaaaatgatgtggatcctgaagttgctcagttaacaaagctgaaatcagcaccccatgatggattgaaacgcgttcttccacgaaggggggaatttgatgtttcgcctgtgaagatgttagcgggtcgagaagggaattattcgggtcgtgggaagttttctttagcagatcgttgtcatatgctaaacaaatatttacctgttaaaggtccttctattgttgaccaattgaccacccgggcttatgtctcacagttttcaaaagacgggtccctttttgttgctgcatttcagggaagtcagattaaaatttataatgctgaaatggggtggaaacttcacaagaaaattgttgctgaaagctttaattggacggttactgacacatctatttcaccagataaacgtttcctgatttattcaactttgtctcctatagtcaacattgtaaatattggatctgctggaacagagtctcatgcaaatgtcacggacatacacgaagggctagaatttgcagctgatgatgaagaaggatatgcatttggaattttttctgtaaaattttctagtgatggtagagaacttgtagccggaagtagtgatgattcaatttatgtttatgatattgaagcaaaaagattttcccttcgaattcaagcgcatacgtcagatgtaaacagtgtatgctttgctgatgaagccagcaatctgatatattctgggagtgatgataatctctgtaaggtttgggacagacgttccatcagatcaaaaggaaagccagttggaatcctcacggggcatctagaaggaattacacatcttgatagccgtaatgatggtcgttatttcatttcaaatggaaaagatcagactattaagctttgggatatcagaaaaatgtcctctaatgcggctcgcgctcctatatccaggaactatgaatgggactacagatggatggactatctacttagggcacgagatgtaaagcatccatctgaccagtccgttgctacatacaaaggtcattcagtattgcgtacactcatacgctgctatttttcaccagaatatagcactggccaaaggtatatttatactggatctcatgattcttgtgtgtatgtttatgatttggttactggggcccgggttgcaagacttgtgcaccataagtcaaccgtgcgggactgcagctggcacccttactatccaatgctcgtcagttcttcgtttgatggagatatcgcaaagtgggaatttcctggaaacggagagaacccgattcccgtgaataacagtaggcctcgacgacaatattatgattaa

SEQ ID NO: 226 - protein, 487 aa, Helianthus annuus
MYSRGWTTLIGDMGYALSRLEIDPDYSDNGSVGDDNDSHQSSSQNDVDPEVAQLTKLKSAPHDGLKRVLPRRGEFDVSPVKMLAGREGNYSGRGKFSLADRCHMLNKYLPVKGPSIVDQLTTRAYVSQFSKDGSLFVAAFQGSQIKIYNAEMGWKLHKKIVAESFNWTVTDTSISPDKRFLIYSTLSPIVNIVNIGSAGTESHANVTDIHEGLEFAADDEEGYAFGIFSVKFSSDGRELVAGSSDDSIYVYDIEAKRFSLRIQAHTSDVNSVCFADEASNLIYSGSDDNLCKVWDRRSIRSKGKPVGILTGHLEGITHLDSRNDGRYFISNGKDQTIKLWDIRKMSSNAARAPISRNYEWDYRWMDYLLRARDVKHPSDQSVATYKGHSVLRTLIRCYFSPEYSTGQRYIYTGSHDSCVYVYDLVTGARVARLVHHKSTVRDCSWHPYYPMLVSSSFDGDIAKWEFPGNGENPIPVNNSRPRRQYYD

SEQ ID NO: 227 - DNA, 1410 bp, Hordeum vulgare
atggcagcggcagggaggctgcggggacggcggcgggcgcagaaggaggtggagcgcgagctcgagccgttcactatcgaggaagaggtgtcccacctcacccgggctttgtcggagccgtgcccgggcacccgcgccgccgtccgtggcgccaggcggaagaggggcgtctcggctttcgacatgctgtcgtcgagggagtccggccggtccggtggcggcgggttctgctcggccgaccgcgcctacgccgccgggaggcacctgcccgcggtagggccgtggtgcgtcgaagacatggatagcgaggcctatgtttcgcagttctccagcgatggctcactgctcgttgctgggtttcggggaagccgcatcagagtttacgatgtcgataaagggtggaaggtgcataagaacataagctgcagaagtatgaggtggacggtttcagacattgctctctcccctgaccagcgataccttgcttattccagtttgtcgcctattgttcacattgtgaatgtgcagaatgctggaagggaatcatatgctaatgttactgaaattcacgagggtttggaattctgtgatgatgatgaatactctttcgggatattctctgtgaaattttcgaaagatggtagagaagttgttgttgggaacaatgattgttcaatatatgtctatgatcttggagcaaataaagtatcagaccgtatccgtgctcatatgggtgatgtcaacacggttacctttgctgatgaaagtggcaatttgttgtactctggaagtgatgataatctctgtaaggtctgggataggcgttgccttgtaagagagaaaccagcaggtgttttgacaggtcatttagatgggattacatttattgatagccgtggtgatgggcgttatctaatctcgaactgcaaggaccagactatcaaactttgggacgtcagaaagatgtccgccaccgtcaaaggacgacaaccgagattatatgactgggactacagatggatgtcgctcccatcacacgctagatattataagcatccagatgatctgtctctggcaacttacaggggtcattcagttctgcggacacttatccgctgctacttctctccaatgcacagcacgggccagaggtacatatacactggatcaagtgatgattcagtgcatatttacgatgtggtaaccggggcgaccgtcaagaagctctcgtggcacggttcgatcatcagagactgcacctggcatccttaccgtccaacacttgtcagctcttcctgggacggctatctggcccggtgggaggcatcaggcgacaacgaggacccctcggtgctcacgtgcgacgagcagaggaatagcccttaccacgagacatacgggctgttgtaa

SEQ ID NO: 228 - protein, 469 aa, Hordeum vulgare
MAAAGRLRGRRRAQKEVERELEPFTIEEEVSHLTRALSEPCPGTRAAVRGARRKRGVSAFDMLSSRESGRSGGGGFCSADRAYAAGRHLPAVGPWCVEDMDSEAYVSQFSSDGSLLVAGFRGSRIRVYDVDKGWKVHKNISCRSMRWTVSDIALSPDQRYLAYSSLSPIVHIVNVQNAGRESYANVTEIHEGLEFCDDDEYSFGIFSVKFSKDGREVVVGNNDCSIYVYDLGANKVSDRIRAHMGDVNTVTFADESGNLLYSGSDDNLCKVWDRRCLVREKPAGVLTGHLDGITFIDSRGDGRYLISNCKDQTIKLWDVRKMSATVKGRQPRLYDWDYRWMSLPSHARYYKHPDDLSLATYRGHSVLRTLIRCYFSPMHSTGQRYIYTGSSDDSVHIYDVVTGATVKKLSWHGSIIRDCTWHPYRPTLVSSSWDGYLARWEASGDNEDPSVLTCDEQRNSPYHETYGLL

SEQ ID NO: 229 - DNA, 1479 bp, Linum usitatissum
atgttcttcgtagcttcaactgacgggatgggttatgccatgagtagattggagatagaatctcagctgtgtgacgaggaagagactgtcaatgaagttggtggtggaagccaacagcacaagtctcttaacaaatcggtagagaaattggaccatgaagttgcccaggacactaacctaaaatctcagccccatagacggctcgagaaggagatacctgggaagagacagttcccagtctctcctgtaaagatgttggccggtcgagaaggtaatttttccggaagggggaggttctcgcgagctgatcggtgtcatatgctcagcagatatttgcctgctgatggcccatggcttgtcgatcgaatgaatagccgagcttatgtctcgcagttttcttctgatggtaccttgtttgttgctggctttcagggaagccatattaaagtatacaatgtcgagaaagggtggaaagttcagaaggatattattgccagaagtttgcgttggacagttacggatacctctctgtctccggatcaacggtttcttgtctatgccagtatgtgccctattgtgcacattgttaatatcgcatcatcaacaacggaatcagttgcaaatgtaacggagattcacgatggtttagacttttctgatgaagacgatgggggctatgctttcgggatcttctcagtaaaattttctactgatggtcgtgaactagttgctggaagtagtgatgatgctatatgtgtctatgatctcgaaactaataagctctctctcagaatcctagcacacacatctgatgtgaacaccgtctgttttgctgacgagagtgggcatctgatatactccgggagtgatgataatctctgcaaggtgtgggatagacgttgcttcatagcaaaagggaagcctgcaggagtcctaacgggacatatcgaaggaattacagatatagacagccgtggagatggccgatatttaatatcaaatggaaaagatcagacaatcaaactttgggatatcaggaaaatggcccccaatgctacaagctctttagggatcaggaattatgaatgggattacagatggatggactacccaccaccagctagagacttgaagcatccatgcgatctgtccgtggctacttataaaggtcactcggttctccgaacgcttattcgctgctatttctcaccaacctatagcaccggccagaaatacatttacaccggatctcacgactcttctgtttatatttatgatgtggcgactggggaggtagctggagtgctgaaacaccataactcgccggtaagagattgcagttggcacccgcactatcctatgctggtgagctcttcatgggatggggatatagtgaggtgggagttcgtcggcaatggagaagctccgatgcctatggccaagaaacgactacgcagaaggcaatactacgatgtctga

SEQ ID NO: 230 - protein, 490 aa, Linum usitatissimum
MFFVASTDGMGYAMSRLEIESQLCDEEETVNEVGGGSQQHKSLNKSVEKLDHEVAQDTNLKSQPHRRLEKEIPGKRQFPVSPVKMLAGREGNFSGRGRFSRADRCHMLSRYLPADGPWLVDRMNSRAYVSQFSSDGTLFVAGFQGSHIKVYNVEKGWKVQKDIIARSLRWTVTDTSLSPDQRFLVYASMCPIVHIVNIASSTTESVANVTEIHDGLDFSDEDDGGYAFGIFSVKFSTDGRELVAGSSDDAICVYDLETNKLSLRILAHTSDVNTVCFADESGHLIYSGSDDNLCKVWDRRCFIAKGKPAGVLTGHIEGITDIDSRGDGRYLISNGKDQTIKLWDIRKMAPNATSSLGIRNYEWDYRWMDYPPPARDLKHPCDLSVATYKGHSVLRTLIRCYFSPTYSTGQKYIYTGSHDSSVYIYDVATGEVAGVLKHHNSPVRDCSWHPHYPMLVSSSWDGDIVRWEFVGNGEAPMPMAKKRLRRRQYY

SEQ ID NO: 231 - DNA, 1422 bp, Lithospermum erythrorhizon
atggggtatgctatgagtagatttgaaactgatgtatctgtaatctttagttcaagttctgattctgagacttctcatgattctcttatcaataagccagtgaaaaatttggatcatgaaattgctcagcttactaggcttagatcagcaccccacgagaatctaagtagagacctactagttaagagggtattgccgctttcgacaatgaaaatgctggctggcagagaagctaatgtttcaggaagagggaggttttcatctgcagattgttgtcatgtagtcagtcgacatttgcctgttaacgatccttgtgttgtcgatcaaatgacatctagagtttatttgtcacagttttcgactgatggttctcttttcattgctggctttcagggatgccacatcagaatatacaatgtagataaagggtggaaagttcaaaacgacattatagcaaaatgtgtgagatggacaattactgatgcatctctttctccagatcaaaagttccttgcctatgctagcttgacaccaattgcacatattgtaaaatttggttctgctgctacggaatctcatgcaaatgttacggatatacatgatggattggatttttcatctaacgatgatgggggatactcttttggggtattttccatcaagttttcaaccgatggacgggaaattgtagctggtaccagtgatgaatcaatttgtgtttatgatctagaagcagatagactttcccttagaatttcagcccacgagtcagatgttaactctgtatgctttgctgatgaaagcggccatcttatttattctggaagtgatgacaatctctgcaaggtttgggacagacgttgcttcaatgccaaaggaaaaccagcaggcatcttgatgggacacctcgaaggaattacatttattgatagccgaggagatgggcgatattttatttcaaatggtaaagatcagacaatcaaactctgggatatccgcaaaatgtcctcgaatgctggcggcacaattcaaagcagaaatagtgaatgggactacagatggatggaatatccacaagaggcaagagatttgaagcatccatctgatctatcgggtgctacttacaaaggccactccgtcttgtgtactcttattcgctgctacttctccccagactatagtactggccagaaatacatctacactggatctcatgatgcaaatgtttatatctacgacttggtaactggagatcaagtttctacacttcagtaccataaggcaactgtaagggattgtagttggcacccaaactatcctatgcttgttagctcatcgtttgacggagaaattgtcaaatgggaatatcgtggaaacgatgaagctcccgtccaaggaaacaatcagcggcttcaaagatga

SEQ ID NO: 232 - protein, 473 aa, Lithospermum erythrorhizon
MGYAMSRFETDVSVIFSSSSDSETSHDSLINKPVKNLDHEIAQLTRLRSAPHENLSRDLLVKRVLPLSTMKMLAGREANVSGRGRFSSADCCHVVSRHLPVNDPCVVDQMTSRVYLSQFSTDGSLFIAGFQGCHIRIYNVDKGWKVQNDIIAKCVRWTITDASLSPDQKFLAYASLTPIAHIVKFGSAATESHANVTDIHDGLDFSSNDDGGYSFGVFSIKFSTDGREIVAGTSDESICVYDLEADRLSLRISAHESDVNSVCFADESGHLIYSGSDDNLCKVWDRRCFNAKGKPAGILMGHLEGITFIDSRGDGRYFISNGKDQTIKLWDIRKMSSNAGGTIQSRNSEWDYRWMEYPQEARDLKHPSDLSGATYKGHSVLCTLIRCYFSPDYSTGQKYIYTGSHDANVYIYDLVTGDQVSTLQYHKATVRDCSWHPNYPMLVSSSFDGEIVKWEYRGNDEAPVQGNNQRLQR

SEQ ID NO: 233 - DNA, 1464 bp, Lycopersicon esculentum
atgtattttgatttcttacacccagagtccattgaagacatggggtattctctaagtaagttagaagtagacaccggactctttgatggttcaagttccaatcatggggttgctagcagtgttcatcatgaaagaccaacaaattatttggaccatgaaatttctcaacttactaagcttagatcaggaccccatgaaaatctcagtagaatcctaccagggaaaaaggaagttcctgtatccgcattcaagatgttagctgctcgagaagccaatatttccggtagaggaaggttttcgaaggcagattgttgtcatgttctaagtaaatatttgccagttagtggtccttggattgtggaccagatggaaaccagagcttatgtatcacaattttcagcagatggttccctttttgttgctgcctttcagggaagtcatattagaatatacaatgtggaaagagggtggaaagttcacaagaatattcatgcaaaaagtttgagatggacagttactgatacatctctttctccggatcaacgtcatttggtctatgctactatgtcacccatcgtacatattgtagatgtaggatctgctgcctctgaatctgtagccaacatcacagaaattcatgatggtttgcttttgtctactgacaatgatgattttggaattttctctgtgaaattttctactgaaggtcgggaagttgttgctggaagtagtgatgatgcgatctatgtttatgatcttgaagcaaacaaactctctcttcgaatatccgcacacaattctgatgtcaattctgtatgttttgctgacgaaagtggccatctcatttattctggaagtgatgacaatctgtgtaaggtctgggatagacgttgttttagggccaaagaaaagccagccggagtcttgatgggacacctagaaggcgttacgttccttgatagtcggggggatggtcgttatttcatttctaacagtaaagatcagtccatcaagctctgggatatccgcaaaatgtcttctcatgctgctcgcaatatctggttcaggaattatgagtgggactatagatggatggactaccctgctcaagctagagacgtgaagcacccttatgatcagtcaatatccacttataagggtcattctgtcttgcgtactctaattcgctgctacttctcaccagaatatagcactgggcagagatacatttacacaggatcccatgatgcctgcgtatacatctatgatttggtaagtggagagcaagtcgcgaaattgcagcaccaccggtcgaccattagagattgtagctggcaccctacttatccaatgcttgttagctcttcttgggatggagatgttgtcaaatgggaattccctggaaatggtgaagcaccactccctccaaaaaggaagcagatcagaagaaggcatttcttttaa

SEQ ID NO: 234 - protein, 487 aa, Lycopersicon esculentum
MYFDFLHPESIEDMGYSLSKLEVDTGLFDGSSSNHGVASSVHHERPTNYLDHEISQLTKLRSGPHENLSRILPGKKEVPVSAFKMLAAREANISGRGRFSKADCCHVLSKYLPVSGPWIVDQMETRAYVSQFSADGSLFVAAFQGSHIRIYNVERGWKVHKNIHAKSLRWTVTDTSLSPDQRHLVYATMSPIVHIVDVGSAASESVANITEIHDGLLLSTDNDDFGIFSVKFSTEGREVVAGSSDDAIYVYDLEANKLSLRISAHNSDVNSVCFADESGHLIYSGSDDNLCKVWDRRCFRAKEKPAGVLMGHLEGVTFLDSRGDGRYFISNSKDQSIKLWDIRKMSSHAARNIWFRNYEWDYRWMDYPAQARDVKHPYDQSISTYKGHSVLRTLIRCYFSPEYSTGQRYIYTGSHDACVYIYDLVSGEQVAKLQHHRSTIRDCSWHPTYPMLVSSSWDGDVVKWEFPGNGEAPLPPKRKQIRRRHFF

SEQ ID NO: 235 - DNA, 1488 bp, Medicago truncatula
atgtacgctatatccggtgcactttacgttgaccaaatgggctatgctatgagtagattagacgtggactctagtgatactgaagatggaaatgcaatccttgaagattctagtactggaaaagctaaaaaggcatttgaaaatttagacaatgaaattgctcaaataaccaagttgaaatcaacacctcatcaactgctagtacatgatggatctggaaggaaagagttgcctgtttccccggtgaagatgctggcaggccgcgaatctaattgttcaggacggggaaggttttcttccgctgatcgctgtcatcttttgagcaggtatttacctgtaaatggtccttggcctatcgaccaaatgcctagtcgagcatacgtgtctcagttttcagctgatggttctctttttgttgctgggttccagggaaaccacataaaaatatacaatgtggagaaaggttggaaagttcaaaaaaacattctaaccaagagtttgagatggacaatcactgatacttctctttcccctgatcaaagtcatctagtttatgccagcatgtcacccattgtacacattgtgaatgttggatcttctgagacagagtcactagcaaatgtgacggagatccacgatgggttggatttttcatcaaacgacgatggaggatactcttttggaattttctctttgaaattttcaacagatgggaaggaattagttgcaggaactagtggcgattctatatatgtatacgatcttgaaacaaataaggtttcacttcgaattttagcacacacggctgatgtaaacactgtatgttttgctgatgaaactggccatcttatttactctggaagtgatgatagtttctgcaaggtctgggatcggcgttgcttaaatgctaaagacaagccagcaggggttttgatgggacaccttgagggcattacgtttattgattcccgtggagatggacgctatttcatttcaaacggtaaagatcagaccatcaaactttgggacatacgtaaaatgtcatccaatgttaccagtaaccgtgtccgtggatataggagttttgaatgggattacaggtggatggattacccgccacaagcaaaagacttgaatcatccttgtgatcagtcagtggctacatatagaggccattcagtcttacgcactcttgtccgctgctttttttctccagcttttagcactggccagaagtacatctatactggatcacacaacgcatgtgtttatgtatatgatttggtgagtggagcacaagttgcaacattgaagcaccataaatcacctgtaagagattgtagttggcatcccttccaccctatgcttgttagctcttcttgggatggagatgttgtaaaatggcaatctgctggaagctctgatatggcagcctcgtcggttaagaagagggtaaacaaaagacatttttatgaagattacctatga

SEQ ID NO: 236 - protein, 495 aa, Medicago truncatula
MYAISGALYVDQMGYAMSRLDVDSSDTEDGNAILEDSSTGKAKKAFENLDNEIAQITKLKSTPHQLLVHDGSGRKELPVSPVKMLAGRESNCSGRGRFSSADRCHLLSRYLPVNGPWPIDQMPSRAYVSQFSADGSLFVAGFQGNHIKIYNVEKGWKVQKNILTKSLRWTITDTSLSPDQSHLVYASMSPIVHIVNVGSSETESLANVTEIHDGLDFSSNDDGGYSFGIFSLKFSTDGKELVAGTSGDSIYVYDLETNKVSLRILAHTADVNTVCFADETGHLIYSGSDDSFCKVWDRRCLNAKDKPAGVLMGHLEGITFIDSRGDGRYFISNGKDQTIKLWDIRKMSSNVTSNRVRGYRSFEWDYRWMDYPPQAKDLNHPCDQSVATYRGHSVLRTLVRCFFSPAFSTGQKYIYTGSHNACVYVYDLVSGAQVATLKHHKSPVRDCSWHPFHPMLVSSSWDGDVVKWQSAGSSDMAASSVKKRVNKRHFYEDYL

SEQ ID NO: 237 - DNA, 1392 bp, Oryza sativa
atgggttatggcatgagtaggatggaggaggaatacagcgagcatgaagatcagaataatggtggatctaattcacaagtgaataatgagttcttaaacacacataatgatattttccatatgactcaaataagatcaggacctagtgaaagtcttcgcaagtctattggtacaagcaaagatgtgatatcgacaaccaggttattgtctggaagggaaattaattcttcaggaaatgggaagttctcttcagttgatcgtgcgtttcttcttggtcgttatcttccagttgatggccctgaaatagtggacaggatggattcccgagcttatgtttcacagttttctgctgatggatctctttttgttgctggttttcagggaagccacataagaatatatgatgttgataaaggttggaaagtacatagggacattcatgctagaagtttgagatggaccattagtgacgcatcactttcccctgatcaacagtttcttgtctactccagtctagcaccgattatccatatcgtcaatgttgggactgctgcaaaacaatcatatgctaatatcactgacatccacgatggactagatttttcacagcatgaagatgttcgatatacatttggaatattttctgttaaattctcttctgatggccgagagcttgttgctggcagtaacgatgattcaatatatgtttatgaccttgtggcaaacaaactaacgttgcgtttgcctgctcatcattctgatgtcaacacagtagcatttgctgacgaaactggccatctcatatattctggaagtgatgataatttatgcaaggtctgggataggcgatgtttatccacagaagaacctgctggagttttgactgggcatttgcatggcattactcatattgatagccgtggagatggtcggtgtttcatatcaaatggaaaagaccaagctatcaaaatgtgggacatcaggaaaatgacatccaatgctgatagttatgaagacagaacctcaaattgggactatagatattcaagatatccacaacagtataagcaactaaagcatccccatgatcagtcaatagctacatactggggccattcagttcttcgtacattgatccgttgctatttttctcctgcatatagcacaggacagaagtacatatatacaggatcctatgattctagtgtttgtatctacgatgtggtgagcggatcacaagttgcaaaactcaaaggatatcatcagctggcaattcgagactgcagttggcatcccttcgaccctatgcttgtcagctcatcctgggacggccgggttgccaagtggtccaggtcttcctgtcagcaagaagagactactgatctcgattga

SEQ ID NO: 238 - protein, 463 aa, Oryza sativa
MGYGMSRMEEEYSEHEDQNNGGSNSQVNNEFLNTHNDIFHMTQIRSGPSESLRKSIGTSKDVISTTRLLSGREINSSGNGKFSSVDRAFLLGRYLPVDGPEIVDRMDSRAYVSQFSADGSLFVAGFQGSHIRIYDVDKGWKVHRDIHARSLRWTISDASLSPDQQFLVYSSLAPIIHIVNVGTAAKQSYANITDIHDGLDFSQHEDVRYTFGIFSVKFSSDGRELVAGSNDDSIYVYDLVANKLTLRLPAHHSDVNTVAFADETGHLIYSGSDDNLCKVWDRRCLSTEEPAGVLTGHLHGITHIDSRGDGRCFISNGKDQAIKMWDIRKMTSNADSYEDRTSNWDYRYSRYPQQYKQLKHPHDQSIATYWGHSVLRTLIRCYFSPAYSTGQKYIYTGSYDSSVCIYDVVSGSQVAKLKGYHQLAIRDCSWHPFDPMLVSSSWDGRVAKWSRSSCQQEETTDLD

SEQ ID NO: 239 - DNA, 1476 bp, Pinus radiata
atgaatacggcaatgcattttggtgctggttggcgatcgattgctgagatggggtatacgatgagcagactagagattgagcctgagtcgtgtgaggacgagaagagcttggatggggttggtaacagccagggaccgaatgagttgccgagatgcttggatcatgagttggcgcatttgacgaatctgaagtcgaggccccatgaacatttgatccgagatttccctgggaggcgggctctgcctgtttccaccgttaagatgctggcgggtcgagagtgtaattattcacgaagagggaggttctcctccgctgattgctgtcacatgctgagcagatatgtgcctgttaatggtccttcgcccctggatcagatgaatagtcgagcttatgtttcgcaattttcagctgatggttctctatttgttgctggctttcagggtagccacattagaatttataatgttgataaaggatggaaatgtcagaagaacattcttaccaagagtttacggtggacgatcactgatacatctctttctcctgaccaacgttaccttgtgtatgccagtatgtcacccatcgtccatattgttgacatcggctccgctgctatggattctcttgcaaacatcacggagatccatgagggtttggatttttccgctgacagtggaccatattcttttggaatcttctctgttaaattttctaccgatggacgagaagtcgtcgctggaagcagcgacgattctatatatgtctatgatcttgtggcaaataagctttccctcagaattccagcacatgagtctgatgtgaacacagtatgctttgctgatgaaagtggtcatataatttattctgggagtgatgatacatactgcaaggtgtgggatagacgttgcctgagtgccagaaataaacctgcaggagttctaatgggacaccttgaaggcattacgttcattgatagccgtggtgatggtcgttatttcatatcaaatggcaaagatcagacgatcaaactttgggatatccggaaaatgggctctgatatctgtcgtcgaggctttaggaatttcgaatgggattacagatggatggactacccaccccgggctagggattcgaaacacccttttgatctgtcagtggcaacatataaaggccattcggtgttgcgtactcttattcggtgctacttctccccagtacatagcactggtcaaaagtatatctacactggatcccatgattcctgtgtttatatctatgatgtggtgactggagctcaagttgcggccctcaagcaccataaatcgccggtcagagactgcagttggcacccggagtacccgatgattgtgagctcttcttgggatggggatattgtgaaatgggaattctttgggaacggagaaactgagatcccggcgatgaagaagaggatccggaggcggcatttgtattaa

SEQ ID NO: 240 - protein, 491 aa, Pinus radiata
MNTAMHFGAGWRSIAEMGYTMSRLEIEPESCEDEKSLDGVGNSQGPNELPRCLDHELAHLTNLKSRPHEHLIRDFPGRRALPVSTVKMLAGRECNYSRRGRFSSADCCHMLSRYVPVNGPSPLDQMNSRAYVSQFSADGSLFVAGFQGSHIRIYNVDKGWKCQKNILTKSLRWTITDTSLSPDQRYLVYASMSPIVHIVDIGSAAMDSLANITEIHEGLDFSADSGPYSFGIFSVKFSTDGREVVAGSSDDSIYVYDLVANKLSLRIPAHESDVNTVCFADESGHIIYSGSDDTYCKVWDRRCLSARNKPAGVLMGHLEGITFIDSRGDGRYFISNGKDQTIKLWDIRKMGSDICRRGFRNFEWDYRWMDYPPRARDSKHPFDLSVATYKGHSVLRTLIRCYFSPVHSTGQKYIYTGSHDSCVYIYDVVTGAQVAALKHHKSPVRDCSWHPEYPMIVSSSWDGDIVKWEFFGNGETEIPAMKKRIRRRHLY

SEQ ID NO: 241 - DNA, 1467 bp, Populus tremuloides
atgtatttttttgctagaagaacttcggtagacgaaatgggttacgctatgagcagactggagactgaatctgaactctgtgatggtggcaagaccattcctgaggctggtagcagcaagagagccagcaattggttgaataacttagaccatgaaattgctcaggttacgaagttgaaatctagtccgcataaacagctggccgaacttgttcccggcatgcataagtcatctgtttccactgttaagatgttggttggtcgagaagctaattattcagcaaggggaagattctctgcagctgatcgttgtcacatgcttagcagatatttgcctgtcaatggaccttggcttgttgaccagatgagtacccgagcctatgtctcgcagttttcagctgatggctctctatttgttgctgggtttcagggaagctatattagaatatacaatgtggagaaggggtggaaagttcagaagaacattcttgccaaaagtttgcgttggactgttaccgatacatctctttccccagatcagcgccatctcgtttatgcaagcatgtcacctattgtccatattgttgatgctgggtctgccgaaacagagtcgcttgcaaacgttacggagtttcatgacggattggacttttcttctggtgatgggggctattcttttggaatcttctctgtgaaattttccactgatgggcgagaacttgttgcaggaagtaatgatgactccatatatgtctacgaccttgaacaaaataagctctccctcagaattttggcacacacgtctgatgttaacactgtatgttttgctgatgaaagtggccaccttatcttttctgggagtgatgataatctttgcaaggtgtgggatagacgctgctttattgcaaaagggaagccagctggagtcctaacaggacacttagaaggcataacatttattgacagccatggagatggtcggtattttatctcaaatggtaaagatcagactatcaaactttgggatattcggaaaatggcccctaatgctactagctattcagggcttaggaattatgaatgggactacaggtggatggactacccatatgaggcaagagatttgaaacacccctgcgatcaatcagtagccacatataaaggtcattcggttctgcgcactcttatccgctgctacttttctcctgtatatagtactggccagaagtacatctacactggatctcatgattcttgtgtttatatttatgacttggtgactggagaactagtttcattactacaacatcataaatcacctgtaagagattgtagttggcacccatattatcccatgctcgtcagctcttcttgggacggagatgtcgtaaaatgggagtttcctggcaatggagaagctccagtcccttcaaccaagaagagaattcgaaggagacaatttgattga

SEQ ID NO: 242 - protein, 488 aa, Populus tremuloides
MYFFARRTSVDEMGYAMSRLETESELCDGGKTIPEAGSSKRASNWLNNLDHEIAQVTKLKSSPHKQLAELVPGMHKSSVSTVKMLVGREANYSARGRFSAADRCHMLSRYLPVNGPWLVDQMSTRAYVSQFSADGSLFVAGFQGSYIRIYNVEKGWKVQKNILAKSLRWTVTDTSLSPDQRHLVYASMSPIVHIVDAGSAETESLANVTEFHDGLDFSSGDGGYSFGIFSVKFSTDGRELVAGSNDDSIYVYDLEQNKLSLRILAHTSDVNTVCFADESGHLIFSGSDDNLCKVWDRRCFIAKGKPAGVLTGHLEGITFIDSHGDGRYFISNGKDQTIKLWDIRKMAPNATSYSGLRNYEWDYRWMDYPYEARDLKHPCDQSVATYKGHSVLRTLIRCYFSPVYSTGQKYIYTGSHDSCVYIYDLVTGELVSLLQHHKSPVRDCSWHPYYPMLVSSSWDGDVVKWEFPGNGEAPVPSTKKRIRRRQFD

SEQ ID NO: 243 - DNA, 1428 bp, Prunus armeniaca
atgagttacagaacaaggtttggaaaagataatagcgcttgtgatagtggaaatgctgttgaaggttctggttcaagtaaaggacccaatgaagtatcaaatgattttgatcatgaaattgctcaactcactaagcatagatcaagaccccatcagcttttgagccaggacatgcctggaaagtcgaggttactggtttcaacaatgaaaatgttggttggtcgtgaaagtaatcattcaggacgtgggagattctcgtctgctgacggttgccatgttttgagccggtatctgcccatcaatggtccttggggggtggaccagtcaacaagtcctgcttatgtttctcaattttcaaatgatggtttgttttttgttgctggatttcagggcggccatattagaatatataatgttgataagggatggaaagttcagaaggacatcctaaccaaaagcttgagatggacaattactgatacatctctatctccagatcaacgttatcttgtttatgctagcatgacacccattgtcaatattgtcaatgttggatcttctatgacagagtcacttgcaaatgttacggaaattcatgaaggtctggatttttctgttggtggtgatgaggacgaatttggaattttctcagttagattttcaactgatgggcgagagcttgtagctgcaagtagagatgcttcaatatatgtttatgatctccaagcaaataaagttaacctccgaataccagcacactcgtctgatgtaaacactgtatgctttgcggatgagactggacatctcatatattctggcagtgacgataatctctgtaaggtttgggatagacgctgctttaatcacaaaggacagccagctggggtcctgatgggacatcttgaaggtgttacatttattgatagtaggggagatgggcgttacttcatatcaaatgggaaggaccagactacccaactctgggatataagaaagatgtcctctagagccatgtacagcccaaggcttagagatcatgactgggattacagatggatggagtacccagctcatgcaaaaactttgaaacatccaaatgatcagtcactggctacatatagaggtcatggagtcctgcgtactttaattcgctgttacctttctccagcatatagtactggacaaaagtacatctacactggatctagtgatcattgtgtctatatatatgatctggtgaccggtgctcaagttgcgagactcaaccatcacgaaggacctgtaagagactgtagttggcatcctctctatccgatgttggtcagctcttcttgggatgggacgattgccagatgggaatttcctggggatgaccaagtacccaccctggagaggccgagagcgcgccggaaggagaggctactataa

SEQ ID NO: 244 - protein, 475 aa, Prunus armeniaca
MSYRTRFGKDNSACDSGNAVEGSGSSKGPNEVSNDFDHEIAQLTKHRSRPHQLLSQDMPGKSRLLVSTMKMLVGRESNHSGRGRFSSADGCHVLSRYLPINGPWGVDQSTSPAYVSQFSNDGLFFVAGFQGGHIRIYNVDKGWKVQKDILTKSLRWTITDTSLSPDQRYLVYASMTPIVNIVNVGSSMTESLANVTEIHEGLDFSVGGDEDEFGIFSVRFSTDGRELVAASRDASIYVYDLQANKVNLRIPAHSSDVNTVCFADETGHLIYSGSDDNLCKVWDRRCFNHKGQPAGVLMGHLEGVTFIDSRGDGRYFISNGKDQTTQLWDIRKMSSRAMYSPRLRDHDWDYRWMEYPAHAKTLKHPNDQSLATYRGHGVLRTLIRCYLSPAYSTGQKYIYTGSSDHCVYIYDLVTGAQVARLNHHEGPVRDCSWHPLYPMLVSSSWDGTIARWEFPGDDQVPTLERPRARRKERLL

SEQ ID NO: 245 - DNA, 1437 bp, Saccharum officinarum
atgcgcggagtgcggcggagcgcgcgcggggaatcgtcccggaaggcggcggcggaccgggaccgggaggtggagcggttcacgctgtgcgccaagatgtcccacctcaccaggaccacgtcggagccgtgccgcagggctcgcggcgccgctccggcgctccggaagaggcccttctcggcgttcgagctggtgtcggcgagggaggccggccgcgcgggcggcgccgggttctccgcggccgaccgagcctacgtcggcaggcagcacatccccaccaaggggccctggggcgtcgacgacgtggacagcgaggcctacgtctcgcagttctccgctgatggctccttgctcatcgctgggtttcggggaagccgcatcagagtctacgacgccgagaaagggtggaagattcataaggatataagctgccaaatggtgcactggacggtttcagacattgctctctcacctgaccaacgattccttgcctatgcaagtttgtcgcctactgttcacattgtgaacgtgcagagtgctggaaaggaatcacatgctaatattactgaaattcatgagggactggatttaactggtggtgatgaggatgaggactttggaatattttctgttaaattctcaaaagatggtaaagaaattgttgttgggaacaatgaaagatcaatatatgtttatgaccttgcaacaaataaagtgtcagcccgcatccgtgctcataaagctgatgtcaatgctgttaccttcgctgatgaaagtggaaatgtgttgtactctggaagtgatgatagtttctgtaaggtgtgggacagacgttgcctttcaggggaaaagtcagcaggtactttaacaggtcatttagatggagttacatttatcgatagccgtggtgatgggcgttatttcatctccaattgcaaggatcagagaatcaaactttgggacatcaggaaaatgtcttccgtcgtgagagctcgcccagtgagtctagtggactgggactataggtgggagctatttccatcagaagcccacaattttaagcatccagatgatcagtctgtggccacatacagaggccattcagttctgcgaacacttatccgttgctatttctcccctgtgcacagcacgggtcagaggtacatatacacaggatccagtgacaagtctgtacatatttatgatgtggtaagcgggaagactgtcaagaggctttcttggcatggctcgatcatcagagactgcacctggcatccatactacccaacgctcgtcagctcctcctgggacggctatgttgcccgctgggaggcatcaggcgacgacgacgacccttcagtgctcgtccacgacgagaagagggcaacccgttactttcggagatacgccaatcccttcacagatcccttcatgtga

SEQ ID NO: 246 - protein, 478 aa, Saccharum officinarum
MRGVRRSARGESSRKAAADRDREVERFTLCAKMSHLTRTTSEPCRRARGAAPALRKRPFSAFELVSAREAGRAGGAGFSAADRAYVGRQHIPTKGPWGVDDVDSEAYVSQFSADGSLLIAGFRGSRIRVYDAEKGWKIHKDISCQMVHWTVSDIALSPDQRFLAYASLSPTVHIVNVQSAGKESHANITEIHEGLDLTGGDEDEDFGIFSVKFSKDGKEIVVGNNERSIYVYDLATNKVSARIRAHKADVNAVTFADESGNVLYSGSDDSFCKVWDRRCLSGEKSAGTLTGHLDGVTFIDSRGDGRYFISNCKDQRIKLWDIRKMSSVVRARPVSLVDWDYRWELFPSEAHNFKHPDDQSVATYRGHSVLRTLIRCYFSPVHSTGQRYIYTGSSDKSVHIYDVVSGKTVKRLSWHGSIIRDCTWHPYYPTLVSSSWDGYVARWEASGDDDDPSVLVHDEKRATRYFRRYANPFTDPFM

SEQ ID NO: 247 - DNA, 1380 bp, Triticum aestivum
atgggttatggcatgagtaggctacatgagggatacagtgagcctgaagggctgaatagtgatggatctagttcagtcgaagtgaataatgatttctcaaagttacacaatgatattttccatatgactcgactaagatcaggacctagtgaaagcatccgcaagtccatggatagagtctcagtgactaggttgttacgtggaagggaagttaattcttcaggaaatggaaagttctctccggttgatcgtgcattcgttcttggtcattatcttccagtggatggtcctgaaacggtggatacaatggattcacgagcttatgtttcacagttttctgccgatggttctctttttgttgctggttttcagggaagccacataagaatatatgatgtcgataaaggttgggaaatacacaaggacattcatgctagaagtttgagatggacaattagtgatgcagcgttatcacctgatcaaaggttccttgtctactctagtctggcacccattatccatattgtcaatgttggcactgcttcaagagaatcatatgctaatgtcactgacatccatgatggattagatttttcagagcatgaagatgttagatattcatttggactcttttctgttaaattttccactgatgggcgggagcttgttgctggcagtaatgatgattcaatatatgtctatgaccttcagaccaacaaagtgacattgcgtttgcctgcccatacatctgatgtcaacacagtagcatttgctgatgaatctggtaacctactttattctggaagcgatgataacttgtgcaaggtctgggacagacgttgtttgtccacaggggaagcggctggggttttgactggacatctgcatggcattactcatattgacagccgtggagatggtcgatgtttcatatcaaatggaaaagatcaagctattaagatgtgggacatccggaaaatgacatccaatgctgatggttccgaaaacagagtccctgcctgggactacagatattcaagatatccacaacagtacaagcaacaaaagcatccacatgaccagtcagtagctacataccggggccattcagttctccgtacattgattcgttgctatttttctcccacatatagcacaggacagaagtacatatatacaggatcttatgatgctagtgtctgcatctatgatgtggtaagtgggtcgcaagttgccaaactgcaaggacatcatcatttggcagttcgagactgcagctggcatccgtccgatccaatgcttgtcagttcatcatgggacggccaggttgccagatggtccaggactcgctccaagcaagatacttgtgaactcgattaa

SEQ ID NO: 248 - protein, 459 aa, Triticum aestivum
MGYGMSRLHEGYSEPEGLNSDGSSSVEVNNDFSKLHNDIFHMTRLRSGPSESIRKSMDRVSVTRLLRGREVNSSGNGKFSPVDRAFVLGHYLPVDGPETVDTMDSRAYVSQFSADGSLFVAGFQGSHIRIYDVDKGWEIHKDIHARSLRWTISDAALSPDQRFLVYSSLAPIIHIVNVGTASRESYANVTDIHDGLDFSEHEDVRYSFGLFSVKFSTDGRELVAGSNDDSIYVYDLQTNKVTLRLPAHTSDVNTVAFADESGNLLYSGSDDNLCKVWDRRCLSTGEAAGVLTGHLHGITHIDSRGDGRCFISNGKDQAIKMWDIRKMTSNADGSENRVPAWDYRYSRYPQQYKQQKHPHDQSVATYRGHSVLRTLIRCYFSPTYSTGQKYIYTGSYDASVCIYDVVSGSQVAKLQGHHHLAVRDCSWHPSDPMLVSSSWDGQVARWSRTRSKQDTCELD

SEQ ID NO: 249 - DNA, 1416 bp, Triticum aestivum
atggcggcggcagggagactgcggggacggcggcggacaaaggaggtggagcgcgagcccgagccgttcaccatcgaggaggaggtgtcccacctcacccgggtccggtcggagccgtgccccggcacccgcgccgccatccatggcgccaagcggaagagggacgtctcggctttcgagatgctgtcgtcgagggagtccggcctctcgggaggcggcgggttctgttcggccgaccgcgcctacgccgccgggaagcacctcccgtcggaaggaccctggtgcgtggaagacatggatagcgaggcctatgtctcgcagttctccagcgatggctcgatgctcgttgccgggtttcggggaagccgcatcagagtttacgatgtcgatagagggtggaaggttcataagaacataagctgcagaagtatgaggtggacggtttcagatattgcgctctcccctgaccagcgatatcttgcctattccagtttgtcgcctattgttcacattgttaatgtgcagaatgctggaagggaatcggatgctaatgttactgaaattcacgatggtttggaattctgtgatgacgatgaatactctttcgggatattctctgtgaaattttcgaaagatggtagagaagtagttgttgggaacaatgattgttcaatatatgtctatgatcttggagcaaataaagtgtcagaccgtatccgtgctcatacgtctgatgtcaacacggtcacctttgctgatgaaagtggcaatttattgtactctggaagtgatgataatctctgtaaggtctgggataggcgttgccttgtaagagagaaaccagcaggtgttttgacaggtcacttagatgggattacatgtattgatagccgtggtgatgggcgttatctaatctccaactgcaaggatcagactatcaaactttgggacatcagaaagatgtccgccaccgtaaaaggacgacaaccaagattgtatgactgggactacagatggatgtcgttcccgtcacacgctagatattataagcatccaaatgatctatctctggcaacatacaggggtcattcagttctgcggacacttatccgctgctacttctctccaatgcacagcacgggccagaggtacatatacactggatcaagtgacgattcagtgcatatttacgatgtggtaacaggggcgaccgtcaagaagctctcgtggcacggttcgatcatcagagactgcacctggcatccttaccgtccaacgctcgtaagctcttcctgggacggctatctggcccggtgggaggcatcaggcaacaatgaggacccctcggtgctcacgtgcgacgagcagaggactagcccttacgaccagacatacgggctctcttttgccctgtag

SEQ ID NO: 250 - protein, 471 aa, Triticum aestivum
MAAAGRLRGRRRTKEVEREPEPFTIEEEVSHLTRVRSEPCPGTRAAIHGAKRKRDVSAFEMLSSRESGLSGGGGFCSADRAYAAGKHLPSEGPWCVEDMDSEAYVSQFSSDGSMLVAGFRGSRIRVYDVDRGWKVHKNISCRSMRWTVSDIALSPDQRYLAYSSLSPIVHIVNVQNAGRESDANVTEIHDGLEFCDDDEYSFGIFSVKFSKDGREVVVGNNDCSIYVYDLGANKVSDRIRAHTSDVNTVTFADESGNLLYSGSDDNLCKVWDRRCLVREKPAGVLTGHLDGITCIDSRGDGRYLISNCKDQTIKLWDIRKMSATVKGRQPRLYDWDYRWMSFPSHARYYKHPNDLSLATYRGHSVLRTLIRCYFSPMHSTGQRYIYTGSSDDSVHIYDVVTGATVKKLSWHGSIIRDCTWHPYRPTLVSSSWDGYLARWEASGNNEDPSVLTCDEQRTSPYDQTYGLSFAL

SEQ ID NO: 251 - DNA, 1461 bp, Vitis vinifera
atgtattttacagccagtgagggtgctgctaatgaaatggggtatgccatgagtagattggagctagattctgatttctgtgatgctggcaaggacatccatggaaatgataacactgaaagactcaacaaagaattgaatcatttagatcatgaaatttcccagctcacaaagcttagatcgggacctcacgaatgtctgagtcagattattcctggaaagcgggactcacctgtttcgacggttaagatgctggcgggtcgagaagggaattattcaggaaggggaaggttctcatcagctgattgttgtcatatgttaagtagatatttgcctgtcaatggtccttggcttgtggaccaaatgacaagtcgagcttatgtgtcgcaattttctgctgatggttccctgtttgttgcagggtttcagggaagccatattagaatatacaatgtggatagagggtggaaagtgcagaagaatattcttgcaaaaagcttgcgatggacagtcactgatacatctctctcccctgatcaacgccatcttgtttatgccagcatgtcacctattgtccatattgttaatattggatctgctgcaacagaatctcttgcaaacattacggagattcatgatggtttggatttttctgctgctgatgatgagggttattctttcggaatcttctcagtgaaattttccacagatgggcgagagcttgtagctggaagtagtgatgattcaatatatgtttatgatcttgaagcaaataagctttcccttagaatttcggcacacacgtctgatgtcaatactgtatgctttgctgatgaaagtgggcatcttatttattccgggagtgatgatagtttgtgcaaggtttgggacagacgttgcttcatatcaaaagggaagcctgcaggagtcctgatgggacacctagaaggaattacttttattgatagccgtagagatggtcgtcatctcatttcaaatagtaaagaccagtctatcaaactttgggacatccgaaaaatgtcctccaatgctacttgcactccagggttcaggaattatgaatgggattatagatggatggattatccaacccaggcaagagagttgaaacacccatgtgatcaatcactttccacttataaaggtcattcagtcctgcgtactctcatacgctgctacttctccccgtcttatagcactggtcagaaatacatctactctggatctagcgattcttgcatttatatttatgatttgctgaccggagcccaagttgcaacactggagcaccataaatcagtcgtaagagattgtaattggcaccctaattatccaatcctggttagctcttcatgggatggagacattgtcaagtgggaattccctgggaatggagagccccctttgatcaagaaacgaatccggcggaaatatttatag

SEQ ID NO: 252 - protein, 486 aa, Vitis vinifera
MYFTASEGAANEMGYAMSRLELDSDFCDAGKDIHGNDNTERLNKELNHLDHEISQLTKLRSGPHECLSQIIPGKRDSPVSTVKMLAGREGNYSGRGRFSSADCCHMLSRYLPVNGPWLVDQMTSRAYVSQFSADGSLFVAGFQGSHIRIYNVDRGWKVQKNILAKSLRWTVTDTSLSPDQRHLVYASMSPIVHIVNIGSAATESLANITEIHDGLDFSAADDEGYSFGIFSVKFSTDGRELVAGSSDDSIYVYDLEANKLSLRISAHTSDVNTVCFADESGHLIYSGSDDSLCKVWDRRCFISKGKPAGVLMGHLEGITFIDSRRDGRHLISNSKDQSIKLWDIRKMSSNATCTPGFRNYEWDYRWMDYPTQARELKHPCDQSLSTYKGHSVLRTLIRCYFSPSYSTGQKYIYSGSSDSCIYIYDLLTGAQVATLEHHKSVVRDCNWHPNYPILVSSSWDGDIVKWEFPGNGEPPLIKKRIRRKYL

SEQ ID NO: 253 - DNA, 1431 bp, Zea mays
atgcaaggaaggatgcgaggcgcgcggcggagcgcgcgcggggaatcgtcccggaaggcggcgggccgcgaggtggagccattcacgctgtgcggcgagatgtcccatctcaccagggccacgtcagagccgtgccgcagggctcgcggcgccgccttcgcccgccgggcgaggcccttctcggcgtacgagctggtgtcggcgcgggaggccggccgcgcgggcggcgccgggttctccgcggccgatcgagcctacctcggcaggcagcacatccccaccaaggggccgtggggcgtcgacgacgtggaaagcgaggcctacgtctcgcagttctccgccgatggctcgttgctcatcgcggggtttcggggaagccgcatcagagtctacgacgccgagaaagggtggaagatccacaaggatataagctgcagaagtgtgcactggacggtttcagatattgctctctcacctgaccaacgattccttgcctatgcaagtctgacacctattgttcacattgtgaatgttcagaatgctggaaaggaatcacatgctaatattactgaaattcatgagggattggatttaaccggtggtgatgaggatgaggactttggaatattttctgttaaattctccaaagatggtaaagaagttgttgttgggaacaatgaaaagtcaatatatgtttatgacctttcagcaaataaagtgtcagcccgcatccgtgctcataaagctgatgtcaatgctgttaccttcgctgatgaaactggaaacgtgttgtactctggaagtgatgatagtctctgtaaggtgtgggacaggcgttgcctttcaggggaaaagtcagcaggtattttgacaggtcatttagatggagttacatttatcgatagccgtggtgatgggcgttatttcatctctcattgcaaggatcagagaatcaaactttgggacatcaggaaaatgtcttccgtcgtgagatctcgcccagtgagtctagtggactgggactataggtggatgccatttccatcagaagctcataatcttaagcatccaggtgatcagtctgtggccacatacagaggccattcagttttgcgaacacttatccgttgctatttttcccctgtgcacagcacgggtcagaggtacatatacacgggatccagtgacaagtctgtacatatttatgacgtggtaaccggggaggctgtcaagaggctttcgtggcatggctccatcatcagagactgcacctggcatccatactacccaacgctcgtcagctcctcctgggacggcttcgttgcccggtgggaggcctcgggcgacgacgacgaccattcggtgctcgttgccgacgagatgagaggaagcccttactaccggagatacggcgatcccttggtgatgtag

SEQ ID NO: 254 - protein, 460 aa, Zea mays
MGYGMSRLDDEYYEAEGQNTGGSGSVQVNDEFATLHNDIFHMTRMRSGLTESYKSMGTNRGIISTAKLLSRREIDCSGKGMFSSGDRAFVLGRHVPMNNPELLDRMDSRAYVSQFSADGTLFVAGFQGSHIRIYDVDRGWSIHKDIHARCLRWTISDVSLSPDQRYLAYSSLAPIIHIVNVGNAARESYANVTDIHDGLDFSQHEDVQYSFGIFSVKFSSDGRELVAGSNDDSIYVYDLHANKLTLRLSAHTSDVNTVAFADETGHLIYSGSDDTLCKVWDRRCLSAGQAAGVLTGHLHGITHIDSRGDGRSFISNGKDQAIKLWDIRKMMSNADSCADGAPAWDYRYSRYPHQHKQLKHPHDQSIATYRGHTVLRTLIRCYFSPSYSTGQKYIYTGSYDSNVCIYDVVSGSQVAKLKWHQMAIRDCSWHPFEPTLVSSSWDGRVVKWTSARDEGASDVD

SEQ ID NO: 255 - DNA, 1383 bp, Zea mays
atgggttatggcatgagtaggctagacgatgaatactatgaggctgaagggcagaatactggtggatctggctcagttcaagtgaacgatgagtttgcaacactacataatgatatttttcatatgacccgaatgagatcaggacttactgaaagctacaagtccatgggtaccaacagaggcataatatcaactgccaagttattatctcgaagggaaattgattgttctggaaaggggatgttctcttctggtgaccgtgcatttgttctaggtcgtcatgttccgatgaacaatcctgaattattggataggatggattctcgtgcttacgtttcacagttttctgctgatggtactctttttgttgctggttttcagggaagtcacataagaatatacgatgttgatagaggctggagcatacacaaagacattcatgctaggtgtttaagatggacaatcagtgatgtatccttatcacctgatcagcggtatcttgcctactctagtctggcacctattatccatattgtcaatgttgggaatgcggcaagagaatcctatgctaacgtcactgacatccatgatggattggatttttcacagcatgaagatgttcaatattcatttggaatattttctgtaaaattttcctctgatggacgggaacttgttgctggcagcaatgatgactcaatatatgtctatgatcttcatgcaaacaaattgacattacgtttatctgctcatacatctgatgtcaatacagtagcatttgctgatgaaaccggccatctcatatattctggaagtgacgacactttatgcaaggtctgggacaggcggtgtttgtccgcaggacaggctgccggagttttgactggacatttgcatgggataacacatattgatagtcgtggagatggccgaagtttcatatccaatggaaaagatcaagcaatcaaactgtgggatatcaggaaaatgatgtccaatgctgatagttgtgcagatggagccccagcctgggactacagatattcaaggtatccgcatcaacataaacagttaaagcatccgcatgatcagtcaatagcgacgtaccgtggacatacagtcctccggacattgatccgttgctacttttctccttcgtatagcactgggcaaaagtacatatatacagggtcgtatgattccaatgtttgcatctatgatgtggtaagtggatcccaggttgcgaagctgaaatggcatcaaatggcgattcgggactgcagttggcacccatttgagcccacgcttgtgagctcatcctgggacggccgggtagtgaaatggaccagcgcacgtgatgaaggggcttctgatgtcgattga

SEQ ID NO: 256 - protein, 476 aa, Zea mays
MQGRMRGARRSARGESSRKAAGREVEPFTLCGEMSHLTRATSEPCRRARGAAFARRARPFSAYELVSAREAGRAGGAGFSAADRAYLGRQHIPTKGPWGVDDVESEAYVSQFSADGSLLIAGFRGSRIRVYDAEKGWKIHKDISCRSVHWTVSDIALSPDQRFLAYASLTPIVHIVNVQNAGKESHANITEIHEGLDLTGGDEDEDFGIFSVKFSKDGKEVVVGNNEKSIYVYDLSANKVSARIRAHKADVNAVTFADETGNVLYSGSDDSLCKVWDRRCLSGEKSAGILTGHLDGVTFIDSRGDGRYFISHCKDQRIKLWDIRKMSSVVRSRPVSLVDWDYRWMPFPSEAHNLKHPGDQSVATYRGHSVLRTLIRCYFSPVHSTGQRYIYTGSSDKSVHIYDVVTGEAVKRLSWHGSIIRDCTWHPYYPTLVSSSWDGFVARWEASGDDDDHSVLVADEMRGSPYYRRYGDPLVM

SEQ ID NO: 257 - DNA, 1491 bp, Citrus sinensis
  misc_feature (665)..(665): n is a, c, g, or t
  misc_feature (666)..(799): n can be a stretch of 105 to 135 nucleotides, where n would be a, c, g, or t
atgttcgtaacagcaagtggagttgactttgacgaaatgggatatgccatgagtagattcgagatagaatctgaattctatgatgctgccgatactgtcaatcaagctagtaatagtcgtagcaaattcaagaaacccttgagtgctttagaccatgaaattgcccagctcacgaagctgaaatcggaacccaaggagcattttagcaaagaagtacctgggaagcggcacttgcctgtttccactgtgaaaatgttggctggtagggaaggcaattattcaggaagagggaggttctcagctgcagattgttgtcatatgcttagtagatatttgcctgttaatgggccctggcctgtggaccagacaactagccgagcatatgtctctcagttttcggctgatggttctttatttgttgctggatttcaggctagtcaaattagaatctatgatgtggagagaggttggaaaatacagaaagacattcttgctaaaagtttgcgttggacagtcacagatacatctctttccccggatcagcgccatcttgtttatgcaagcatgtcacctatagtgcacattgttgatgttggttctgggacaatggagtctcttgcaaatgttacggagatacatgatggattggacttttctgctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctcagaattttggcacacacgtctgatgttaacactgtatgttttggtgatgaaagtggccatctaatctattctgggagtgatgacaatctatgcaaggtatgggatagacgctgtctaaatgtgaaagggaagccagcaggagtcctgatgggacacctagaagggatcacgttcattgatagccgtggagatggtcgttatctgatctcaaatggtaaagatcaggccatcaaactttgggatattcggaaaatgtcctctaatgcatcctgcaatttaggatttaggagttatgaatgggattacagatggatggactacccaccccaggcaagagatttgaaacacccatgtgatcaatccgttgctacgtataaaggtcattctgtcttgcgtactcttatccggtgccacttttcccctgtatacagcactggccaaaagtatatctacactggatcccatgattcttgtgtttatgtttatgacctggtgagtggtgagcaagttgctgcactcaagtaccatacttcacccgttagagactgtagttggcacccaagtcaaccaatgcttgttagctcttcttgggatggagatgttgtcaggtgggagtttccgggtaatggagaagctgctcctcctctaaacaagaagaggatccggaggagacagttttacttgtga

SEQ ID NO: 258 - protein, 495 aa, Citrus sinensis
  misc_feature (222)..(222): Xaa can be any naturally occurring amino acid
  misc_feature (223)..(266): Xaa can be a stretch of 35 to 45 amino acids, where Xaa would be any naturally occurring amino acid
MFVTASGVDFDEMGYAMSRFEIESEFYDAADTVNQASNSRSKFKKPLSALDHEIAQLTKLKSEPKEHFSKEVPGKRHLPVSTVKMLAGREGNYSGRGRFSAADCCHMLSRYLPVNGPWPVDQTTSRAYVSQFSADGSLFVAGFQASQIRIYDVERGWKIQKDILAKSLRWTVTDTSLSPDQRHLVYASMSPIVHIVDVGSGTMESLANVTEIHDGLDFSAAXXXXXXXXXXXXXXXXXXXXXXXXXXXXXXXXXXXXXXXXXXXXXLRILAHTSDVNTVCFGDESGHLIYSGSDDNLCKVWDRRCLNVKGKPAGVLMGHLEGITFIDSRGDGRYLISNGKDQAIKLWDIRKMSSNASCNLGFRSYEWDYRWMDYPPQARDLKHPCDQSVATYKGHSVLRTLIRCHFSPVYSTGQKYIYTGSHDSCVYVYDLVSGEQVAALKYHTSPVRDCSWHPSQPMLVSSSWDGDVVRWEFPGNGEAAPPLNKKRIRRRQFYL

SEQ ID NO: 259 - DNA, 1119 bp, Glycine max
atgtctagtagggcttatgtctcccagttttcagctgatggctctctttttattgctgggttccagggaagtcacataagaatatacaacgtggacagaggttggaaagttcagaagaacattctagctaaaaatttgagatggacaatcactgatacatctctttcacctgatcaacgctatctagtttatgccagtatgtcacctattgtacacattgtaaatgccggatctgctgaaacggagtccctagcaaatgttacagagatacatgatggtttggatttttcatcaaatgatgatggaggatactcctttggaattttctgtgtgaaattctcaaaagatgggaaagaattagttgcaggaagtagtggtgattctatatatgtatacgatcttgaagcaaataagctctcacttcgaattttagctcacacgtgtgatgtgaacactgtatgttttgctgatgaaactagccatcttatttactctgggagtgatgatagtttctgcaaggtctgggatcggcgttgcttgattgctaaaggcaagccagcaggggttttaatgggacaccttgagggcattacatttattgatactcgaggagatggacgctatttcatttcaaatggtaaagatcaaaccattaaactttgggacatacgcaaaatgtcatccaatgttaccagcaatcctgggtataggagttacgaatgggattacaggtggatggattatccaccccaagcaaaagacttgactcacccttgtgatcagtcagtggctacttatagaggccattcggtcttacgcactctcatccgctgctatttctccccagcgtttagcacgggccagaagtacatctatactggatcacacaacgcatgtgtttatatatatgatttggtaagtggagctcaagtcgcaacgctgaagcaccataaatcacctgtaagagattgtagctggcaccccttccacactacacttgttagctcttcttgggatggagatgttgtgaaatgggaatttgctgggagtggtgatacaccaggctcttcaactaagaagagggtatggacaagacatttttatgaacattacctatga

SEQ ID NO: 260 - protein, 372 aa, Glycine max
MSSRAYVSQFSADGSLFIAGFQGSHIRIYNVDRGWKVQKNILAKNLRWTITDTSLSPDQRYLVYASMSPIVHIVNAGSAETESLANVTEIHDGLDFSSNDDGGYSFGIFCVKFSKDGKELVAGSSGDSIYVYDLEANKLSLRILAHTCDVNTVCFADETSHLIYSGSDDSFCKVWDRRCLIAKGKPAGVLMGHLEGITFIDTRGDGRYFISNGKDQTIKLWDIRKMSSNVTSNPGYRSYEWDYRWMDYPPQAKDLTHPCDQSVATYRGHSVLRTLIRCYFSPAFSTGQKYIYTGSHNACVYIYDLVSGAQVATLKHHKSPVRDCSWHPFHTTLVSSSWDGDVVKWEFAGSGDTPGSSTKKRVWTRHFYEHYL

SEQ ID NO: 261 - DNA, 448 bp, Hordeum vulgare
atgggttatggcatgagtaggctgcatgagggatacagtgaacatgaagggcagaatagtgatggatctagttcagtcgaagtgaataatgacttctcaaaattaaataatgatattttccacatgactcgactaagatcaggacctagtgaaagcatccgcaagtccatggatagagtctcagtaactaggttgttacgtggaagggaagttaactcttcaggaaatggaaagttttctccggttgatcgtgcattcgttcttggtcattatcttccagtggatggtcctgaaacagtggacaggatggattcacgagcttatgtttcacatttttctgccgatggttctctttttgttgctggttttcagggaagccacataagaatatatgatgtcgataaaggctgggaagtacacaaggatattcatgctagaagtttgagat

SEQ ID NO: 262 - protein, 149 aa, Hordeum vulgare
MGYGMSRLHEGYSEHEGQNSDGSSSVEVNNDFSKLNNDIFHMTRLRSGPSESIRKSMDRVSVTRLLRGREVNSSGNGKFSPVDRAFVLGHYLPVDGPETVDRMDSRAYVSHFSADGSLFVAGFQGSHIRIYDVDKGWEVHKDIHARSLR

SEQ ID NO: 263 - DNA, 1029 bp, Hordeum vulgare
aactcgtgcatgccttcatgctggcaagagccatatctctacattcaagctgttgtcatcaagagaatccaatcgctccggatttggtagattctcttcagccgattgctcttatgctcttcgcaaacacctaccagtaagaggcccgtggtgtgttgatagcatggattgcgcagcatacatctcacaattctctttggatggttctctactaattgggaggcgtatcagaatctataacgctgacaaaaaatggaagatccacaaggatataacctgcaaaagtctgcggtggacagtatcagatattgctctctcacctgatcaacaatacctagcatattccagtctgtcccctactgttcacatagtaaatgttcagaatgctccgaagcagtcacatgctaatattacaatgcaggatgttcatgagggtttgaatttttctgctgctgctgatgaatcctcctttggaatattttcaataaagttttcaaaagatgggcatgaacttgttgttggaaacagcaatgagtcaatatgtatttatgatcttggagcaaacaaagtgacagagcgaattcatgctcatgtggctgatgttaatgcggtcacgttcgctgatgaatctggtggtgtcttgtactccggaagtgatgatagcctctgtaaggtgtgggataggcgttgccacaacagagcgaaaccagtaggtgttttggcaggtcatttagatggagttacatttattgatagccatggagacgggcattatttcatctccaactgcaaggatcagactattaaactatgggatatcagaaaattgtcctcggctacgaaggactgcacaccaaaagcatacgaatgggattacagatggatgacctatccatcagaagcccgatttttgaagcatccatatgatcaatcgctagccacattcagaggccattcggtgttgcgcacacttatccgttgctacttttccccaatgcacagcacaggtcagaggtatatatacacagg

SEQ ID NO: 264 - protein, 342 aa, Hordeum vulgare
TRACLHAGKSHISTFKLLSSRESNRSGFGRFSSADCSYALRKHLPVRGPWCVDSMDCAAYISQFSLDGSLLIGRRIRIYNADKKWKIHKDITCKSLRWTVSDIALSPDQQYLAYSSLSPTVHIVNVQNAPKQSHANITMQDVHEGLNFSAAADESSFGIFSIKFSKDGHELVVGNSNESICIYDLGANKVTERIHAHVADVNAVTFADESGGVLYSGSDDSLCKVWDRRCHNRAKPVGVLAGHLDGVTFIDSHGDGHYFISNCKDQTIKLWDIRKLSSATKDCTPKAYEWDYRWMTYPSEARFLKHPYDQSLATFRGHSVLRTLIRCYFSPMHSTGQRYIYT

SEQ ID NO: 265 - DNA, 1555 bp, Pinus taeda
  misc_feature (730)..(730): n is a, c, g, or t
  misc_feature (731)..(1059): n can be a stretch of 315 to 330 nucleotides, where n could be a, c, g, or t
gctcgtagacattgaaggtccggaagctttgccaagcacagagaacagaactgcaagcacaggacaaagggagagaatgggaaactcacagtttcaaaatcatcattttgacaaagatgataacagtaacagaaatgatgaagtccaaaatatggatgatgcttctgaagatcccaacaaacttcaccatgaacttgaacatataacaaagctgaggtcagcaccaaatggtatgctgtccaggatgaatggtaagagccagaatggctatgtttcaacattatctatgttggcaggcagagaagccaatatttctgggagagggaaatttagtgtagctgattgctgtcatgttgcaagtagatatttgccatcttgtggcccagatataatggatatgatggacagtagagcatatattggacaattttcagcagatggctccctttttgtcacaggatttcaggatcatcggataagaatatacaatgtggagaatggatggacaattcaaaaggatgtgcttgctagaaacttgcgttggactatcactgacacttctctttcacctgatcagcgttaccttgtgtatgctactatcactcctattgtccacattgtgaatgttggaagcagtgtcagagaatccttagcaaacgtcacagaaattcatgaagcgctggatttctctatgtacgaagaacattgctcatttggaattttctgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattactttcatcgatagtcgtggagatggacgctattttatttctaatggaaaagaccagacgacaaagatgtgggatattcgcaaaatgactgcaggaaatcctagcataaagtcaaggagttcctctggtaatgaatgggattatcgttggatggagtatccaaagaataggaagaatgctaagcatccatatgaccagtctctgatgacttacaggggacatgctgtcttgcgtactcttgtccgctgctacttctctccatccttcagcactggccagaaatacatctacacaggatcacacgatggctgtgtttatatttatgatgtggtaagtgggaacctcattaagaaactcgactatcataggtccactgtgagggactgcagctggcatccgttctatccaactcttgtaagctgttcatgggatggagttgttgccaaatgggaccattcaacagcaagaagtcgcagaagccgcagcccgtga

SEQ ID NO: 266 - protein, 470 aa, Pinus taeda
  misc_feature (197)..(197): Xaa can be any naturally occurring amino acid
  misc_feature (198)..(306): Xaa can be a stretch of 105 to 110 amino acids, where Xaa would be any naturally occurring amino acid
MGNSQFQNHHFDKDDNSNRNDEVQNMDDASEDPNKLHHELEHITKLRSAPNGMLSRMNGKSQNGYVSTLSMLAGREANISGRGKFSVADCCHVASRYLPSCGPDIMDMMDSRAYIGQFSADGSLFVTGFQDHRIRIYNVENGWTIQKDVLARNLRWTITDTSLSPDQRYLVYATITPIVHIVNVGSSVRESLANVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITFIDSRGDGRYFISNGKDQTTKMWDIRKMTAGNPSIKSRSSSGNEWDYRWMEYPKNRKNAKHPYDQSLMTYRGHAVLRTLVRCYFSPSFSTGQKYIYTGSHDGCVYIYDVVSGNLIKKLDYHRSTVRDCSWHPFYPTLVSCSWDGVVAKWDHSTARSRRSRSP

SEQ ID NO: 267 - DNA, 1269 bp, Saccharum officinarum
  Unsure (566)..(566)
  misc_feature (566)..(566): n is a, c, g, or t
atgggttatggcatgagtaggctagaagatgaatattatgagcctgaagggcagaatactgatggatctggctcagttcaagtgaacgatgagtttgcaaaactgcacaacgatatttttcatatgacacgaatgagatcaagacttactgaaaggtacaagtccatggataccaacagaggcataatatcaacggccaagttattatctcgaagggaaattgattgttctggaaaggggatgttctcttcttgtgaccgtgcatttgttctaggtcgctatgttccaatgaatggccctgaattattggataggatggattctcgtgcttatgtttcacagttttctgctgatggtactctttttggtgctggttttcagggaagtcacataagaatatatgatgctgatagaggctggagcatacacaaagacattcatgctaagtgtttgagatggacaatcagtgatgtattcctatcacctgatcaacggtatcttgcctactctagtctggcacctattaatcatattggcaatgtcggaaatgctggaagagaatcctngtcgacccacgcgtccggccggcagcaatgatgaatcaatatatgtctatgaccttcaagcaaacaaattgacattacgtttacctgctcatacatctgatgtcaatacagtagcatttgctgatgaaaccggccatctcatatattcaggaagtgacgacactttatgcaaggtctgggacaggcggtgtttgtccacaggacaagctgccggagttttgactggacatttgcatggggtaacacacattgatagtcgtggagatggccgaagtttcatatccaatggaaaagaccaagcaatcaaactgtgggatgtcaggaaaatgacgtccaatgctgatagttgtgcagacggagccccaacttgggactacagatattcaaggtatccgcagcagcataaacagttaaagcatccgcatgatcagtcattagcgacataccgtggacattcagtcctccggacattgatccgttgctacttttctcctgcttacagcactgggcaaaagtacatatatacagggtcgtatgattcctgcgttcacatctatgatgtggtaagtggatcgcaagttgcgaagctgaaatggcatcaaatggcgatacgtgactgcagctggcacccatttgagcccacgcttgtgagctcatcctgggacggccatgtagcgaaatggaccagtgcacgtgatcaaaa

SEQ ID NO: 268 - protein, 461 aa, Saccharum officinarum
  misc_feature (189)..(189): Xaa can be any naturally occurring amino acid
  misc_feature (190)..(228): Xaa can be a stretch of 30 to 40 amino acids, where Xaa would be any naturally occurring amino acid
MGYGMSRLEDEYYEPEGQNTDGSGSVQVNDEFAKLHNDIFHMTRMRSRLTERYKSMDTNRGIISTAKLLSRREIDCSGKGMFSSCDRAFVLGRYVPMNGPELLDRMDSRAYVSQFSADGTLFGAGFQGSHIRIYDADRGWSIHKDIHAKCLRWTISDVFLSPDQRYLAYSSLAPINHIGNVGNAGRESXXXXXXXXXXXXXXXXXXXXXXXXXXXXXXXXXXXXXXXXRPTRPAGSNDESIYVYDLQANKLTLRLPAHTSDVNTVAFADETGHLIYSGSDDTLCKVWDRRCLSTGQAAGVLTGHLHGVTHIDSRGDGRSFISNGKDQAIKLWDVRKMTSNADSCADGAPTWDYRYSRYPQQHKQLKHPHDQSLATYRGHSVLRTLIRCYFSPAYSTGQKYIYTGSYDSCVHIYDVVSGSQVAKLKWHQMAIRDCSWHPFEPTLVSSSWDGHVAKWTSARDQ

SEQ ID NO: 269 - DNA, 1337 bp, Sorghum bicolor
  misc_feature (528)..(528): n is a, c, g, or t
  misc_feature (529)..(692): n can be a stretch of 135 to 165 nucleotides, where n would be a, c, g, or t
atgggttatggcatgagtaggctagaagatgaatactatgagcctgaagggcagaatactgatggatctggctcagttcaagtgaacaatgagtttgcagaactgcataacgatatttttcatatgacccgaatgagatcaagacttactgaaagctacaagtccatgggtaccaacagaggcataatatcaacggccaagttattatctcaaagggaaattgattgttctggaaagaagatgttctcttctggtgaccgtgcatttgttctaggtcgctatgttccaatgaacggccctcagttattggataggatggattctcgtgcttatgtttcgcagttttctgctgatggcactctttttgttgctggttttcagggaagtcacataagaatatatgatgctgatagaggctggagcatacacaaagacattcatgctaggtggttgagatggacaatcagtgatgtatccttatcacctgatcagcggtatcttgcctactctagtctggcacctattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttacctgctcatacatctgatgtcaatacagtagcatttgctgatgaaactggccatctcatatattctggaagtgacgacactttatgcaaggtctgggacaggcggtgtttgtccacaggacaagctgccggagttctgactggacatttgcatggggtaacacatattgatagtcgtggagatggccgaagtttcatatcgaatggaaaagaccaagcaatcaaactgtgggatgtcaggaaaatgacgtccaatgctgatagttgtgcagacggagccccaagttgggactacagatattcgaggtatccgcagcagcataaacagttaaagcatccgcatgatcagtcattagcgacataccgtggacatgcagtcctccggacattgatccgttgctacttttctcctgcttacagcactgggcaaaagtacatatatacagggtcgtatgattcctgcgtttacatctatgatgtggtaagtggatcgcaagttgcgaagctgaaatggcatcaaatggcgattcgtgactgcagttggcacccatttgagcccacgcttgtgagctcatcctgggacggccaggtagcaaaatggaccagtgcacgtgatcaacaggcttctgatatagattga

SEQ ID NO: 270 - protein, 445 aa, Sorghum bicolor
  misc_feature (177)..(177): Xaa can be any naturally occurring amino acid
  misc_feature (178)..(231): Xaa can be a stretch of 45 to 55 amino acids, where Xaa would be any naturally occurring amino acid
MGYGMSRLEDEYYEPEGQNTDGSGSVQVNNEFAELHNDIFHMTRMRSRLTESYKSMGTNRGIISTAKLLSQREIDCSGKKMFSSGDRAFVLGRYVPMNGPQLLDRMDSRAYVSQFSADGTLFVAGFQGSHIRIYDADRGWSIHKDIHARWLRWTISDVSLSPDQRYLAYSSLAPIVXXXXXXXXXXXXXXXXXXXXXXXXXXXXXXXXXXXXXXXXXXXXXXXXXXXXXXXRLPAHTSDVNTVAFADETGHLIYSGSDDTLCKVWDRRCLSTGQAAGVLTGHLHGVTHIDSRGDGRSFISNGKDQAIKLWDVRKMTSNADSCADGAPSWDYRYSRYPQQHKQLKHPHDQSLATYRGHAVLRTLIRCYFSPAYSTGQKYIYTGSYDSCVYIYDVVSGSQVAKLKWHQMAIRDCSWHPFEPTLVSSSWDGQVAKWTSARDQQASDID

SEQ ID NO: 271 - protein, 336 aa, Artificial sequence
  Conserved Domain comprised in SEQ ID NO: 02
YVSQFSTDGSLFIAGFQGSRIRIYNVEKGWKVQKDILAKSLRWTVTDTSLSPDQRNLVYASMSPIVHIVDVGSGSTESHANVTEIHDGLDFSSDEDGGYSFGIFSVKFSTDGREVVAGSSDDSIYVYDLEANRVSLRTVAHTSDVNTVCFADESGNLILSGSDDNLCKVWDRRCFIGRDKPAGVLVGHLEGVTFIDSRGDGRYFISNGKDQTIKLWDIRKMSSSAPARHEVLRNYEWDYRWMDYPTEARDLKHPLDQSVSTYKGHSVLRTLIRCYFSPAHSTGQKYIYTGSNDSSVYIYDLVSGDKVAVLKHHSSPVRDCNWHPYYPTLISSSWDG

SEQ ID NO: 272 - DNA, 2194 bp, Oryza sativa; identical to SEQ ID NO: 75

SEQ ID NO: 273 - DNA, 1245 bp, Oryza sativa
cttgttgttgatctgtgcccccaagaagaataacactctactcttacttgttggaaaaaaatagtattagcaaccacgcatatgcaaattttaatgcagtaataataagagatggatcgatcgttttccagctcttgtatatgtgactggccctgctttatgtgtgtagtgttaatttcagctttagcagtacgtgattagtgatggacaataattgtcgcagacgtatctatcaattgctcctgttgtgtgatgctttaactgttggaatcaaagttgcgttgcctttgttgttatgaggaggaatatatatgttggggcaggaaaagaatggaggagagatcgttctccatatccttatcatcggcctcgtcactgctcgcagtttaactttttggtgatgcgagcgatggtcagccatatatatactcccatgctgcatgctagtaatcaatatacgccttgtaaaagtaaacgatcgtctagtaattgcaatatcataggggtagccattgacagagatctacatagatagagggggaacaagaattgacactccacagatgctccactcattcacctttactaatttatatcttttgatgtttgatcgatcgatcgatccgtccgtcggtgtctcgacgaataaaaactgcaaatcgaactgtatgtatataatatagcgtcgtaaattaaattaaattaaatcgaactgaatactacatgtcgaagcaagaattagttcaactaaaagatttagtttttccggttgcaatatctgtgaaattaattgaagaaattaagaagaaaactggagagatatatatatggatgagacaaaatgagataagacgcatgatggtccctcggatgatgtcgtccgttccttatttccattccatggcagctgctatcgctatctagtgcgcgcggcatctccaatcccatccattctagtggtcgatctagctactactgagtattgttttttcttctttttactactgttgattattctgcaactgcagttagatgcttgctactcctacatcgatctctctcgcgcgggcgtatgcattgcattcactactgatgatccgtgggtgtagtgtgggtggctataaatagggcagggtgcggttgccattgctcctcaggccagcaactgagaagctccatacaagtaagcagcagctagttgccgacaaggccagagaaggaagaagaagctctcatcatcatcac

SEQ ID NO: 274 - DNA, 56 bp, Artificial sequence
  primer: prm09100
ggggacaagtttgtacaaaaaagcaggcttaaacaatgttttttggaccaagtgag

SEQ ID NO: 275 - DNA, 50 bp, Artificial sequence
  primer: prm09101
ggggaccactttgtacaagaaagctgggttgtgtagagagacgcatcagt

SEQ ID NO: 276 - protein, 309 aa, Zea mays
MAMLKSAVLWRKRFGITSLLDADLGLPELENVVFYRGADREGHPVCYNVYGEFQDKDLYEKAFGDDEKRERFLKWRIQLLERGILSKLDFSPNGICSMVQVTDLKNSPPMLGKHRAVTRQAVTLLQDNYPEFIAKKVFINVPWWYLAANKMMSPFFTQRTKSKFVFASPAKSAETLFRYIAPEQVPVQFGGLFKEDDPEFTTLDTVTELTIKPSSKETIEIPVTENSAIVWELRVLGWEVSYSAEFTPDTEGGYTVIIQKTRKVPANEEPIMKGSFKVGEPGKLVLTVNNPASKKKKLLYRSKVKSISE

SEQ ID NO: 277 - protein, 634 aa, Artificial Sequence
  Consensus sequence
  misc_feature (2)..(17): Xaa can be any naturally occurring amino acid
  misc_feature (19)..(59): Xaa can be any naturally occurring amino acid
  misc_feature (61)..(196): Xaa can be any naturally occurring amino acid
  misc_feature (198)..(266): Xaa can be any naturally occurring amino acid
  misc_feature (274)..(274): Xaa can be any naturally occurring amino acid
  misc_feature (277)..(293): Xaa can be any naturally occurring amino acid
  misc_feature (314)..(314): Xaa can be any naturally occurring amino acid
  misc_feature (318)..(318): Xaa can be any naturally occurring amino acid
  misc_feature (321)..(321): Xaa can be any naturally occurring amino acid
  misc_feature (327)..(332): Xaa can be any naturally occurring amino acid
  misc_feature (335)..(335): Xaa can be any naturally occurring amino acid
  misc_feature (339)..(339): Xaa can be any naturally occurring amino acid
  misc_feature (344)..(345): Xaa can be any naturally occurring amino acid
  misc_feature (354)..(354): Xaa can be any naturally occurring amino acid
  misc_feature (356)..(356): Xaa can be any naturally occurring amino acid
  misc_feature (378)..(378): Xaa can be any naturally occurring amino acid
  misc_feature (380)..(380): Xaa can be any naturally occurring amino acid
  misc_feature (388)..(388): Xaa can be any naturally occurring amino acid
  misc_feature (404)..(404): Xaa can be any naturally occurring amino acid
  misc_feature (408)..(409): Xaa can be any naturally occurring amino acid
  misc_feature (414)..(414): Xaa can be any naturally occurring amino acid
  misc_feature (435)..(435): Xaa can be any naturally occurring amino acid
  misc_feature (442)..(442): Xaa can be any naturally occurring amino acid
  misc_feature (455)..(455): Xaa can be any naturally occurring amino acid
  misc_feature (467)..(467): Xaa can be any naturally occurring amino acid
  misc_feature (478)..(478): Xaa can be any naturally occurring amino acid
  misc_feature (488)..(488): Xaa can be any naturally occurring amino acid
  misc_feature (515)..(517): Xaa can be any naturally occurring amino acid
  misc_feature (519)..(519): Xaa can be any naturally occurring amino acid
  misc_feature (521)..(521): Xaa can be any naturally occurring amino acid
  misc_feature (525)..(526): Xaa can be any naturally occurring amino acid
  misc_feature (528)..(529): Xaa can be any naturally occurring amino acid
  misc_feature (541)..(541): Xaa can be any naturally occurring amino acid
  misc_feature (550)..(551): Xaa can be any naturally occurring amino acid
  misc_feature (590)..(590): Xaa can be any naturally occurring amino acid
  misc_feature (592)..(592): Xaa can be any naturally occurring amino acid
  misc_feature (598)..(599): Xaa can be any naturally occurring amino acid
  misc_feature (604)..(604): Xaa can be any naturally occurring amino acid
  misc_feature (606)..(606): Xaa can be any naturally occurring amino acid
  misc_feature (616)..(616): Xaa can be any naturally occurring amino acid
  misc_feature (623)..(623): Xaa can be any naturally occurring amino acid
  misc_feature (632)..(633): Xaa can be any naturally occurring amino acid
DXXXXXXXXXXXXXXXXLXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXIWGVPLLXDDXXXXXXXXXXXXXXXXXTDVVLLKFLRARDFKVKEAMXMLKXTVXWRKEFXXXXXXIDXLLDXEDLGXXELEKVVFMXGXDREGHPVCYNVYGEFQDKDLYXKXFGDEEKRXRFLRWRIQLLERGIRXLDFXXPGGIXSIVQVTDLKNSPGPGKRELRXATKQALXLLQDNYPEFVAKXVFINVPWWYLAXYKMISPFLTQXRTKSKFVFAXPSKSAETLFKYIAPEQVPVQYGGLSKXXXEXDXEFTXXDXXVTELTVKPSSKXTVEIPVTEXXSTIVWELRVLGWEVSYGAEFVPDAEGSYTVIVQKTRKVXAXDEPVMXXSFKVXEXGKIVLTVDNXTSKKKKXLLYRFKVKXXS

SEQ ID NO: 278 - protein, 440 aa, Artificial Sequence
  Consensus sequence
  misc_feature (6)..(6): Xaa can be any naturally occurring amino acid
  misc_feature (9)..(22): Xaa can be any naturally occurring amino acid
  misc_feature (25)..(25): Xaa can be any naturally occurring amino acid
  misc_feature (32)..(32): Xaa can be any naturally occurring amino acid
  misc_feature (43)..(50): Xaa can be any naturally occurring amino acid
  misc_feature (53)..(54): Xaa can be any naturally occurring amino acid
  misc_feature (101)..(101): Xaa can be any naturally occurring amino acid
  misc_feature (110)..(115): Xaa can be any naturally occurring amino acid
  misc_feature (136)..(136): Xaa can be any naturally occurring amino acid
  misc_feature (139)..(139): Xaa can be any naturally occurring amino acid
  misc_feature (154)..(154): Xaa can be any naturally occurring amino acid
  misc_feature (157)..(157): Xaa can be any naturally occurring amino acid
  misc_feature (160)..(162): Xaa can be any naturally occurring amino acid
  misc_feature (189)..(189): Xaa can be any naturally occurring amino acid
  misc_feature (193)..(193): Xaa can be any naturally occurring amino acid
  misc_feature (195)..(195): Xaa can be any naturally occurring amino acid
  misc_feature (197)..(197): Xaa can be any naturally occurring amino acid
  misc_feature (200)..(200): Xaa can be any naturally occurring amino acid
  misc_feature (204)..(204): Xaa can be any naturally occurring amino acid
  misc_feature (206)..(209): Xaa can be any naturally occurring amino acid
  misc_feature (211)..(212): Xaa can be any naturally occurring amino acid
  misc_feature (216)..(217): Xaa can be any naturally occurring amino acid
  misc_feature (219)..(221): Xaa can be any naturally occurring amino acid
  misc_feature (226)..(227): Xaa can be any naturally occurring amino acid
  misc_feature (230)..(230): Xaa can be any naturally occurring amino acid
  misc_feature (238)..(238): Xaa can be any naturally occurring amino acid
  misc_feature (246)..(246): Xaa can be any naturally occurring amino acid
  misc_feature (249)..(249): Xaa can be any naturally occurring amino acid
  misc_feature (254)..(256): Xaa can be any naturally occurring amino acid
  misc_feature (259)..(265): Xaa can be any naturally occurring amino acid
  misc_feature (267)..(270): Xaa can be any naturally occurring amino acid
  misc_feature (272)..(283): Xaa can be any naturally occurring amino acid
  misc_feature (285)..(293): Xaa can be any naturally occurring amino acid
  misc_feature (295)..(296): Xaa can be any naturally occurring amino acid
  misc_feature (300)..(306): Xaa can be any naturally occurring amino acid
  misc_feature (314)..(314): Xaa can be any naturally occurring amino acid
  misc_feature (316)..(316): Xaa can be any naturally occurring amino acid
  misc_feature (321)..(321): Xaa can be any naturally occurring amino acid
  misc_feature (323)..(332): Xaa can be any naturally occurring amino acid
  misc_feature (334)..(335): Xaa can be any naturally occurring amino acid
  misc_feature (338)..(343): Xaa can be any naturally occurring amino acid
  misc_feature (346)..(348): Xaa can be any naturally occurring amino acid
  misc_feature (350)..(361): Xaa can be any naturally occurring amino acid
  misc_feature (364)..(364): Xaa can be any naturally occurring amino acid
  misc_feature (367)..(392): Xaa can be any naturally occurring amino acid
  misc_feature (394)..(396): Xaa can be any naturally occurring amino acid
  misc_feature (400)..(401): Xaa can be any naturally occurring amino acid
  misc_feature (403)..(403): Xaa can be any naturally occurring amino acid
  misc_feature (405)..(432): Xaa can be any naturally occurring amino acid
  misc_feature (434)..(435): Xaa can be any naturally occurring amino acid
  misc_feature (437)..(438): Xaa can be any naturally occurring amino acid
MEIQSXGRXXXXXXXXXXXXXXIDXLMEKVLXMNILSSDYFKXXXXXXXXELXXLKTYHEVIDEIYNQVDHVEPWMTGNCRGPSTAFCLLYKLFTMKLTVXQMHGLLKHXXXXXXDSPYIRALGFLYLRYVGDPKXLWXWYEPYIKDDEEFSPXGSXGKXXXTTMGVYVRDLLLGQYYFDTLLPRIPVXVIRXIXGXLEXMKLXTXXXXSXXGGDXXRXXXEDTAXXRPXSVKASLSXSFGQRAPXRAXTRDSXXXRRXXXXXXXRXXXXDXXXXXXXXXXXXSXXXXXXXXXDXXRDRXXXXXXXRDRDRDRXRXRDRDXDXXXXXXXXXXRXXRDXXXXXXDRXXXRXXXXXXXXXXXXRDXDRXXXXXXXXXXXXXXXXXXXXXXXXXXRXXXRSRXXRXRXXXXXXXXXXXXXXXXXXXXXXXXXXXXSXXLXXLK

SEQ ID NO: 279 - protein, 629 aa, Artificial Sequence
  Consensus sequence
  misc_feature (6)..(13): Xaa can be any naturally occurring amino acid
  misc_feature (15)..(17): Xaa can be any naturally occurring amino acid
  misc_feature (19)..(20): Xaa can be any naturally occurring amino acid
  misc_feature (24)..(24): Xaa can be any naturally occurring amino acid
  misc_feature (26)..(26): Xaa can be any naturally occurring amino acid
  misc_feature (33)..(33): Xaa can be any naturally occurring amino acid
  misc_feature (36)..(37): Xaa can be any naturally occurring amino acid
  misc_feature (40)..(40): Xaa can be any naturally occurring amino acid
  misc_feature (43)..(43): Xaa can be any naturally occurring amino acid
  misc_feature (49)..(49): Xaa can be any naturally occurring amino acid
  misc_feature (51)..(57): Xaa can be any naturally occurring amino acid
  misc_feature (156)..(158): Xaa can be any naturally occurring amino acid
  misc_feature (165)..(165): Xaa can be any naturally occurring amino acid
  misc_feature (167)..(167): Xaa can be any naturally occurring amino acid
  misc_feature (188)..(188): Xaa can be any naturally occurring amino acid
  misc_feature (196)..(200): Xaa can be any naturally occurring amino acid
  misc_feature (203)..(208): Xaa can be any naturally occurring amino acid
  misc_feature (212)..(213): Xaa can be any naturally occurring amino acid
  misc_feature (222)..(222): Xaa can be any naturally occurring amino acid
  misc_feature (229)..(232): Xaa can be any naturally occurring amino acid
  misc_feature (234)..(258): Xaa can be any naturally occurring amino acid
  misc_feature (260)..(260): Xaa can be any naturally occurring amino acid
  misc_feature (262)..(263): Xaa can be any naturally occurring amino acid
  misc_feature (265)..(265): Xaa can be any naturally occurring amino acid
  misc_feature (268)..(268): Xaa can be any naturally occurring amino acid
  misc_feature (273)..(273): Xaa can be any naturally occurring amino acid
  misc_feature (276)..(276): Xaa can be any naturally occurring amino acid
  misc_feature (280)..(283): Xaa can be any naturally occurring amino acid
  misc_feature (289)..(291): Xaa can be any naturally occurring amino acid
  misc_feature (297)..(297): Xaa can be any naturally occurring amino acid
  misc_feature (302)..(302): Xaa can be any naturally occurring amino acid
  misc_feature (318)..(318): Xaa can be any naturally occurring amino acid
  misc_feature (321)..(321): Xaa can be any naturally occurring amino acid
  misc_feature (347)..(347): Xaa can be any naturally occurring amino acid
  misc_feature (382)..(382): Xaa can be any naturally occurring amino acid
  misc_feature (384)..(386): Xaa can be any naturally occurring amino acid
  misc_feature (393)..(393): Xaa can be any naturally occurring amino acid
  misc_feature (399)..(400): Xaa can be any naturally occurring amino acid
  misc_feature (409)..(409): Xaa can be any naturally occurring amino acid
  misc_feature (420)..(420): Xaa can be any naturally occurring amino acid
  misc_feature (432)..(432): Xaa can be any naturally occurring amino acid
  misc_feature (445)..(445): Xaa can be any naturally occurring amino acid
  misc_feature (454)..(454): Xaa can be any naturally occurring amino acid
  misc_feature (460)..(460): Xaa can be any naturally occurring amino acid
  misc_feature (463)..(463): Xaa can be any naturally occurring amino acid
  misc_feature (465)..(465): Xaa can be any naturally occurring amino acid
  misc_feature (471)..(471): Xaa can be any naturally occurring amino acid
  misc_feature (473)..(473): Xaa can be any naturally occurring amino acid
  misc_feature (475)..(496): Xaa can be any naturally occurring amino acid
  misc_feature (498)..(514): Xaa can be any naturally occurring amino acid
  misc_feature (516)..(516): Xaa can be any naturally occurring amino acid
  misc_feature (518)..(518): Xaa can be any naturally occurring amino acid
  misc_feature (520)..(521): Xaa can be any naturally occurring amino acid
  misc_feature (523)..(523): Xaa can be any naturally occurring amino acid
  misc_feature (525)..(546): Xaa can be any naturally occurring amino acid
  misc_feature (548)..(549): Xaa can be any naturally occurring amino acid
  misc_feature (551)..(551): Xaa can be any naturally occurring amino acid
  misc_feature (555)..(555): Xaa can be any naturally occurring amino acid
  misc_feature (558)..(558): Xaa can be any naturally occurring amino acid
  misc_feature (569)..(569): Xaa can be any naturally occurring amino acid
  misc_feature (572)..(572): Xaa can be any naturally occurring amino acid
  misc_feature (579)..(579): Xaa can be any naturally occurring amino acid
  misc_feature (590)..(590): Xaa can be any naturally occurring amino acid
  misc_feature (597)..(597): Xaa can be any naturally occurring amino acid
  misc_feature (606)..(606): Xaa can be any naturally occurring amino acid
  misc_feature (629)..(629): Xaa can be any naturally occurring amino acid
MGRSRXXXXXXXXGXXXSXXDDPXSXRSKRKKXASXXDNXESXSAGQGXAXXXXXXXGKKALYHCNYCNKDISGKIRIKCAVCPDFDLCVECFSVGAEVTPHKSNHPYRVMDNLSFPLICPDWNADEEILLLEGIEMYGLGNWAEVAEHVGTKSKXXXQCIDHYXSXYMNSPCFPLPDMSHVLGKNRXELLAMAKXXXXXKKXXXXXXGELXXKEESPFSPXRVKVEDXXXXGXXXXXXXXXXXXXXXXXXXXXXXXXSXSXXAXGAXKKASXVAXIKDXXXXIKVEDXXXDRSVGXKKPRXSGDEGPSLTELSGYNXKRXEFDPEYDNDAEQLLAEMEFKETDTEXERELKLRVLRIYSKRLDERKRRKDFILERNLLYPXPXXXFEKDLSXEEREIXXRYKVFMRFXSKEEHEELLRXVIEEHRILKRIXELQEARAAGCRTXAEAERYIEXKRKKEXEEXAXRAKESXQXGXXXXXXXXXXXXXXXXXXXXXXGXXXXXXXXXXXXXXXXXDXSXKXXGXAXXXXXXXXXXXXXXXXXXXXXXSXXDXWDIXGFXGADLLSESEKXLCXEIRLLPXHYLKMQEVLTXEIFKGNXITKKSDAHXLFKVDPSKVDRVYDMLVKKGIAX

SEQ ID NO: 280 - protein, 21 aa, Homo sapiens
QILFSGGDDAICKVWDRRTMR

SEQ ID NO: 281 - protein, 21 aa, Homo sapiens
RYLISNSKDQTIKLWDIRRFS

SEQ ID NO: 282 - protein, 21 aa, Aspergillus niger
HILYSGSDDTTLRVWDRRSMG

SEQ ID NO: 283 - protein, 21 aa, Aspergillus niger
RYVLSNGKDQSMKLWDLRKMM

SEQ ID NO: 284 - protein, 42 aa, Artificial Sequence
  Consensus
  misc_feature (21)..(21): Xaa can be any naturally occurring amino acid
HLIYSGSDDNLCKVWDRRCLXRYFISNGKDQTIKLWDIRKMS

SEQ ID NO: 285 - protein, 485 aa, Artificial Sequence
  Consensus sequence
  misc_feature (10)..(10): Xaa can be any naturally occurring amino acid
  misc_feature (12)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(24): Xaa can be any naturally occurring amino acid
  misc_feature (28)..(40): Xaa can be any naturally occurring amino acid
  misc_feature (43)..(43): Xaa can be any naturally occurring amino acid
  misc_feature (54)..(54): Xaa can be any naturally occurring amino acid
  misc_feature (58)..(58): Xaa can be any naturally occurring amino acid
  misc_feature (60)..(62): Xaa can be any naturally occurring amino acid
  misc_feature (68)..(70): Xaa can be any naturally occurring amino acid
  misc_feature (85)..(85): Xaa can be any naturally occurring amino acid
  misc_feature (90)..(90): Xaa can be any naturally occurring amino acid
  misc_feature (108)..(108): Xaa can be any naturally occurring amino acid
  misc_feature (214)..(214): Xaa can be any naturally occurring amino acid
  misc_feature (217)..(218): Xaa can be any naturally occurring amino acid
  misc_feature (259)..(259): Xaa can be any naturally occurring amino acid
  misc_feature (296)..(296): Xaa can be any naturally occurring amino acid
  misc_feature (346)..(353): Xaa can be any naturally occurring amino acid
  misc_feature (367)..(368): Xaa can be any naturally occurring amino acid
  misc_feature (376)..(376): Xaa can be any naturally occurring amino acid
  misc_feature (400)..(400): Xaa can be any naturally occurring amino acid
  misc_feature (432)..(433): Xaa can be any naturally occurring amino acid
  misc_feature (436)..(436): Xaa can be any naturally occurring amino acid
  misc_feature (438)..(438): Xaa can be any naturally occurring amino acid
  misc_feature (466)..(466): Xaa can be any naturally occurring amino acid
  misc_feature (468)..(469): Xaa can be any naturally occurring amino acid
  misc_feature (471)..(471): Xaa can be any naturally occurring amino acid
  misc_feature (474)..(476): Xaa can be any naturally occurring amino acid
  misc_feature (478)..(478): Xaa can be any naturally occurring amino acid
  misc_feature (480)..(480): Xaa can be any naturally occurring amino acid
  misc_feature (482)..(484): Xaa can be any naturally occurring amino acid
MGYAMSRLEXEXXXXDXGXSXXXXGSSXXXXXXXXXXXXXLDXEISQLTKLRSXPHEXLXXXVPGKRXXXPVSTVKMLAGRESNXSGRGXRFSSADRCHMLSRYLPVXGPWLVDQMDSRAYVSQFSADGSLFVAGFQGSHIRIYNVDKGWKVQKDILAKSLRWTVTDTSLSPDQRFLVYASMSPIVHIVNVGSAATESHANVTEIHDGLDFSSXDDXXYSFGIFSVKFSTDGRELVAGSSDDSIYVYDLEANKLSLRIXAHTSDVNTVCFADESGHLIYSGSDDNLCKVWDRRCLXAKGKPAGVLTGHLEGITFIDSRGDGRYFISNGKDQTIKLWDIRKMSSNAXXXXXXXXRNYEWDYRWMDYPXXARDLKHPXDQSVATYKGHSVLRTLIRCYFSPXYSTGQKYIYTGSHDSSVYIYDLVSGAQVAKLXXHHXSXVRDCSWHPYYPMLVSSSWDGDVVKWEFXGXXEXPSXXXKXRXRXXXY

SEQ ID NO: 286 - protein, 21 aa, Artificial Sequence
  Conserved sequence which is similar to the PtdIns (4,5)P2 binding motif found in clathrin-coated vesicle proteins
  misc_feature (2)..(11): Xaa can be any naturally occurring amino acid
  misc_feature (12)..(12): Xaa can be any naturally occurring amino acid or no amino acid
  misc_feature (13)..(13): Xaa is Lys, Arg, or Thr
  misc_feature (17)..(17): Xaa can be any naturally occurring amino acid or no amino acid
  misc_feature (18)..(19): Xaa is Lys, Val, or Ala
KXXXXXXXXXXXXKKKXXXYR

SEQ ID NO: 287 - protein, 8 aa, Artificial Sequence
  PRP38 polypeptide dipeptide cluster
RSRSRSRS

SEQ ID NO: 288 - protein, 26 aa, Artificial Sequence
  Zn finger
  misc_feature (2)..(3): Xaa can be any naturally occurring amino acid
  misc_feature (5)..(22): Xaa can be any naturally occurring amino acid
  misc_feature (24)..(25): Xaa can be any naturally occurring amino acid
CXXCXXXXXXXXXXXXXXXXXXCXXC

The invention claimed is:

1. A method for enhancing yield-related traits in a plant relative to a control plant, comprising:
   a) increasing expression in a plant of a nucleic acid encoding a plant PATELLIN polypeptide comprising an amino acid sequence having at least 95% sequence identity to the amino acid sequence of SEQ ID NO: 2; and
   b) selecting for a plant having enhanced yield-related traits relative to a control plant,
   wherein said increased expression is obtained by transforming and expressing in said plant the nucleic acid encoding said PATELLIN polypeptide,
   and wherein said yield-related traits are selected from the group consisting of seed weight, harvest index, plant height, and number of filled seeds.

2. The method of claim 1, wherein said nucleic acid encoding said PATELLIN polypeptide hybridizes with a nucleic acid encoding the amino acid sequence of SEQ ID NO: 2 under high stringency conditions comprising hybridization at 65° C. in 1×SSC or at 42° C. in 1×SSC and 50% formamide, followed by washing at 65° C. in 0.3×SSC and 0.5-10% SDS.

3. The method of claim 1, wherein said enhanced yield-related traits are obtained under conditions of nitrogen deficiency.

4. A method for making a plant having enhanced yield-related traits relative to a control plant comprising:
   a) transforming a plant cell, plant or part thereof with a construct comprising:
      (i) a nucleic acid encoding a PATELLIN polypeptide as set forth in claim 1;
      (ii) a promoter operably linked to said nucleic acid; and
      (iii) a transcription termination sequence;
   b) expressing said construct in a plant cell, plant or part thereof; and
   c) selecting for a plant having enhanced yield-related traits relative to a control plant,
   wherein said yield-related traits are selected from the group consisting of seed weight, harvest index, plant height, and number of filled seeds.

5. A method for the production of a transgenic plant having enhanced yield-related traits relative to a control plant, comprising:
   (i) transforming and expressing in a plant cell a nucleic acid encoding a PATELLIN polypeptide as set forth in claim 1;
   (ii) cultivating the plant cell under conditions promoting plant growth and development, and obtaining transformed plants expressing said PATELLIN polypeptide; and
   (iii) selecting for a plant having enhanced yield-related traits relative to a control plant,
   wherein said enhanced yield-related traits are selected from the group consisting of seed weight, harvest index, plant height, and number of filled seeds.

6. The method of claim 1, wherein the PATELLIN polypeptide comprises the amino acid sequence of SEQ ID NO: 2.

* * * * *